United States Patent 7,745,391 (HUMAN THROMBOSPONDIN POLYPEPTIDE) - sequence listing, part 180

SEQ ID NO: 442593 - DNA, 3828 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggactttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442594 - DNA, 4387 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtccgcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaaaaacacaacaaccccaacaacc

SEQ ID NO: 442595 - DNA, 4227 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatat

SEQ ID NO: 442596 - DNA, 3256 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagttaccatgcagcgtacggtaccggctcgatctt

SEQ ID NO: 442597 - DNA, 1696 bp, Homo sapiens
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggctggagtgcagtgacgtgatctcggctcactgcaactgccactgggctcaagccatcttcccacctccgcctcctgaatagctgggactacaggcgcacgccaccacgcctaggtaatttttgtagagacaagctttcgctatattgcccaggc

SEQ ID NO: 442598 - DNA, 597 bp, Homo sapiens
  misc_feature (429)..(429): n is a, c, g, or t
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgcngatgaatagcgaggtgccgatgaatagcgaggtgccgatgaatagcgaagtgccgatgaatagcgaggtgccgatgaatagcgaggtgccgatgaatagcgaacctcgctattcatcggcaccattagctctagaggtccatgcatactgatattatacgtgtgatcc

SEQ ID NO: 442599 - DNA, 2496 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 442600 - DNA, 1059 bp, Homo sapiens
ctttaagacagaaaaaacctttaagcttcaatcagaaaaaacctttaagacagaagtgctctcaccgtcctacaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgttaaaaaaaaaaaaaaaaaaaaaaaaaaaaaaaaaaaaaaaaaaaaaaaagggggggggggggaaaaagtattcccgggggggcccattggggggtgacccccagagtttttttgtgtggtcaaccagaggggtggccccatatagaggagggcgtgcgtttattattaaaacgacagagggacagctgggggcgggtggtgaaaaaccgcgtgctaggggagcgggggaggaaaactgtgcgccgctgggggagtctttgtggggagagagagaacgacttacctacttggcggggggggccagacacatattagtggggacgacattctctcctacacggaagtatttagcacggctctgagagggagaaatttctacaattttgcaaagggtgattcggggtgtgaacaacaacgggtggtaattatgcgtgggctcagagaggtcggccaacggggtttag

SEQ ID NO: 442601 - DNA, 2257 bp, Homo sapiens
  misc_feature (12)..(12): n is a, c, g, or t
  misc_feature (16)..(16): n is a, c, g, or t
  misc_feature (23)..(23): n is a, c, g, or t
  misc_feature (31)..(31): n is a, c, g, or t
  misc_feature (44)..(44): n is a, c, g, or t
  misc_feature (51)..(51): n is a, c, g, or t
  misc_feature (58)..(58): n is a, c, g, or t
  misc_feature (68)..(68): n is a, c, g, or t
  misc_feature (81)..(81): n is a, c, g, or t
  misc_feature (110)..(110): n is a, c, g, or t
  misc_feature (119)..(119): n is a, c, g, or t
  misc_feature (125)..(125): n is a, c, g, or t
  misc_feature (140)..(140): n is a, c, g, or t
  misc_feature (143)..(143): n is a, c, g, or t
  misc_feature (148)..(148): n is a, c, g, or t
  misc_feature (152)..(152): n is a, c, g, or t
  misc_feature (155)..(155): n is a, c, g, or t
  misc_feature (159)..(159): n is a, c, g, or t
  misc_feature (161)..(161): n is a, c, g, or t
  misc_feature (166)..(166): n is a, c, g, or t
  misc_feature (170)..(170): n is a, c, g, or t
  misc_feature (184)..(184): n is a, c, g, or t
  misc_feature (202)..(202): n is a, c, g, or t
  misc_feature (210)..(210): n is a, c, g, or t
  misc_feature (213)..(213): n is a, c, g, or t
  misc_feature (224)..(224): n is a, c, g, or t
  misc_feature (239)..(239): n is a, c, g, or t
  misc_feature (250)..(251): n is a, c, g, or t
  misc_feature (264)..(264): n is a, c, g, or t
  misc_feature (269)..(270): n is a, c, g, or t
  misc_feature (279)..(279): n is a, c, g, or t
  misc_feature (307)..(307): n is a, c, g, or t
  misc_feature (309)..(309): n is a, c, g, or t
  misc_feature (318)..(318): n is a, c, g, or t
  misc_feature (325)..(325): n is a, c, g, or t
  misc_feature (327)..(328): n is a, c, g, or t
  misc_feature (338)..(338): n is a, c, g, or t
  misc_feature (340)..(340): n is a, c, g, or t
  misc_feature (364)..(364): n is a, c, g, or t
  misc_feature (408)..(408): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (430)..(430): n is a, c, g, or t
  misc_feature (466)..(466): n is a, c, g, or t
  misc_feature (497)..(497): n is a, c, g, or t
  misc_feature (501)..(501): n is a, c, g, or t
  misc_feature (548)..(548): n is a, c, g, or t
  misc_feature (554)..(554): n is a, c, g, or t
  misc_feature (569)..(569): n is a, c, g, or t
gtcatcatctcnaccncgacagnacgccagngccccgccggatnccaccgnaccagangacgaacganacggacccctacnaacctaaaataatactcttcgccacacanaagacgacncggacnaaacccagatacaangcnggacnaaanatnggcngnccgcnggtnaaaaggaggctagnaactggaaaataaaaatnaatacatngcnaaaaaaagtgngcaaactcggggaanaagacgcaatnnaggaaaaagtatnaaatnnccggggganaagtaaaactatgaaaaataaataaatntnaaaaaaaancgattantnnagctgctgancnactcggctgaaggtgtcgtcgaantgaactgggatgcagaggtgctgaaagtgcaaaaacggagaatntataaaatnaanaaagtncttnagggaataaaactcattgaaaaaaaatcaaaaaacnaaatcaagtggctgggcaaaacaaaaaagtnggcntcggcggacggcttgaagggttgaaacaggacctccgaaagatgcanaaagcnaaaaaatggaaaatnatgaatatatgtactagtaatggctgctctcagaggacactgacagaaagcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 442602 - DNA, 2817 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgt

SEQ ID NO: 442603 - DNA, 2959 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgttaaaaaaaaaaaaaaaaaaaaaaaaaaaaaaaaaaaaaaaaaaaaaaaagggggggggggggaaaaagtattcccgggggggcccattggggggtgacccccagagtttttttgtgtggtcaaccagaggggtggccccatatagaggagggcgtgcgtttattattaaaacgacagagggacagctgggggcgggtggtgaaaaaccgcgtgctaggggagcgggggaggaaaactgtgcgccgctgggggagtctttgtggggagagagagaacgacttacctacttggcggggggggccagacacatattagtggggacgacattctctcctacacggaagtatttagcacggctctgagagggagaaatttctacaattttgcaaagggtgattcggggtgtgaacaacaacgggtggtaattatgcgtgggctcagagaggtcggccaacggggtttag

SEQ ID NO: 442604 - DNA, 2476 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 442605 - DNA, 2621 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 442606 - DNA, 2175 bp, Homo sapiens
  misc_feature (2)..(2): n is a, c, g, or t
  misc_feature (5)..(6): n is a, c, g, or t
gnaanngtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 442607 - DNA, 741 bp, Homo sapiens
ttcattttcttggggatcatagtcctgcattgactgttctttagtgtttgaaaacacatttttcgtatatcttgtctatattttagttgtttatgatggacgtatttagataatttaatatctttttttatgtgaatattttccatttttaaatgtgtccaaaaaaagttttaggaacacaggctgagctacaaaatgtttatacattttttttaaaaaaaaaaacatgctgagtcaggcgcggtggctcatgcctgtaatcccagcactttgagatggaggagggcagatcgtgaggtcagaagatagagaccatcctggctaacacagtgaaacaccatctctactaaaaatacaaaaaattagtccggcgtagtggcgggcccctgtagtcccagctacttgggaggctgaggcaggagaatggcgtgaacccgggaggtggagcttgcagtaagtggagattgtgccactgcactccagcctgggtgacagagcgagactctgtctcaaaaaaaaaaaaattggctaagggtggggtcttggaatgaatgaatgaattttatttacttataatagataatatatattatatataaattataaatatatatatttatagagagacactgtctctattatctttatagaggttgtagataatgtctctattattatagagtgagaccctgtctctattatctatatagagattatagatagtgtctttattatctagat

SEQ ID NO: 442608 - DNA, 5587 bp, Homo sapiens
  misc_feature (4227)..(4227): n is a, c, g, or t
cccaagggttcatgggtagcgtatttacaaaggagcctcctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgntgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaaaaaaatgctgtgg

SEQ ID NO: 442609 - DNA, 513 bp, Homo sapiens
gtgactctagcaggatcctcgggatgaggaacgtcactcatgaagagtacatgaagaatcttctcaaagtgggagggatccttgtcatgccactggaagagaaggtcagattcccttcataactgacatttctgcacactgtgtgccaaggtctgttctgggcagtgtacggatacttactcttttaacaatttcctgcatttcacaaatgaggaaacagaggcagggacaggtgagggagatgcagggtcacgcacatgccctagctggggccagaagctgactcaggtgggtgcttcagagcctgcacgtgaaacgcttttctccaccttccttctctgtctctctctttttccttcttctgtcccttccccctcacctccctcttccttccccttctccttccccccagctgttctgagttttaattctaattgttaatctattataattgttctgctgttagaattatatataaaatagagtcattctattctcatcattagtctaatt

SEQ ID NO: 442610 - DNA, 699 bp, Homo sapiens
cccaagggttcatgggtagcgtatttacaaaggagcctcctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaagaaaatgagttccgaggtgagctgttaaatcagaggtggacacacggaggcaaggccagcagctgcaggacctccagcaaggatccagctgtgactcagggcatggctcaaggacagtgatggcgtagggtgtaggcaaggagggctatgcagttgtagtgggaacttcatttgggggtgcttgtgttttactctcaaaacccaacctttttcttttgaatctggtggcgagaatgtacattttaatgggtctgttatagacaacttgctgagcacctccgctcatattttggctcccgcaggattatcagtgctctgctgatccatgttggagcctggggcacaaggaagagtcagtaatatggatcctgtctttatttaaggttttggtatct

SEQ ID NO: 442611 - DNA, 3900 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442612 - DNA, 7434 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatcctta

SEQ ID NO: 442613 - DNA, 6828 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442614 - DNA, 7213 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442615 - DNA, 3954 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggaggtagagccgccgccgccgccgccgcccctcggtccggcctgcggcgagcgggtgtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442616 - DNA, 3160 bp, Homo sapiens
tctcattttgtctctgggatagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442617 - DNA, 3846 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaaggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442618 - DNA, 7584 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgtacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442619 - DNA, 2210 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccaagttgccatcaggtatctacgggtggaactctctagacggtgcacttcatgacgggactcgatggaccgggttagaccgaggctg

SEQ ID NO: 442620 - DNA, 958 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttacggtctccctcttttgtccaaggctggagtgtggtagtgctatcacagctgactgcagcctcaaccttccagg

SEQ ID NO: 442621 - DNA, 2994 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgccaactttcg

SEQ ID NO: 442622 - DNA, 567 bp, Homo sapiens
ctcagagcgtctcgtgtccaagctcctggaaacctggtggcagctagtggaatgcctgccgtggggagcggtctgggagactctggcgctagaagtcttgctcttatgtatacacagtctttaattgaacactcgtaaaactgtaatgagccatttatttatttgaatggggcgagttattaattttcagcaaactgcaggcagccattctgaggtgaatcgtctggagacattctgctccccagggtgaaggtctgcgacaggctctgagatctgagcccatcgcctgatgtggccttgcctttttatttcccctcagctgccccaccccaggatgcacaggctcagggcacgtccggggcaagtactccaggcaccgaaggtaagaggacccttggatctcacggagattcctgggcggtagatttggagcccctgcccactctgcagatggagaactttccatctttttccatggctcccaaggccaggctgctgacccttctgcgaggcagcgacctcccactctagcgtggagatctgtgtggccatgggcgtgccatgtgg

SEQ ID NO: 442623 - DNA, 576 bp, Homo sapiens
tagagacggggtttcaccatgttggccaggctgttcttgaactcctgacctcaggtgatccaactgcctcggcctcccaaagtgctgggattacagtcatgacccaccgcacccggcctaaatttgaatttcaaataaacgtcaaataacttttagtattgttgtttaccttaatttccaattgaactgggattttttttccttctaaatctggcatctctgggtggggcaggggatgaggtgggtgttgacaaaagataatctattattttcagaattcagaatttcaaattggtatctgtttagaacttctattgttctgctcttacctttaacataaatcgctctttttaaacatttttaattatagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacat

SEQ ID NO: 442624 - DNA, 644 bp, Homo sapiens
acaaacaggtgaggcctgtgtcagttccatttgcaaatacatgtttcttctttagttcattagtaagacctgaacacttggtttgtctccattttcaaatgattctttaaaagtttgtgagcagagaagcccaggcctcaagtatttacgatgtggtgagccgtgatactgtgatgagacttcaaaactttgtgaatgtctgtagttacacatgttaagtcagacgtgttacagttggtagaagtgaacagatgagcaagagttcttactctggttctacatgttttcttattcttaaaccttttaggtccttttggtgtgaaccatggggtggaacttcactcagatgtgatagagtatgcaaagcagaaactggacttcttcatcagaacaagtgatagttttgacaagtaagatgaaatactatccattggctcagatgatgtgaactgtaattttacaaagttttgatcagatagaaagaaatcatgtggtaggaaacataattaaactgtggtgggatgattctatgtgcctgttctaattttcagaaaagattctgtgttttgagggttttagggtatttcaaactgttacacatacataaggtgttcatttgctcaatattcatgtttcctgttgaa

SEQ ID NO: 442625 - DNA, 7641 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442626 - DNA, 7604 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442627 - DNA, 3764 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442628 - DNA, 4162 bp, Homo sapiens
gtgtattatatttggttaatttggagattgctctggggaataggttatgggactaggagtagggttaggatgagtgggaagaagtaagagaggaacttaagttgaattatgccttttttgggttgaggtgatgatggaggtggagatttggttctgtgaaattgttttaggttatagcttttctagtcaggctaggtctaggaggagtaggggcaggttttggtgagtgttttagtggggttagcgatggaggtaggaatggtgctgtgggtgaaagagtgggatgaggtgggtgttgacaaaagataatctattattttcagaattcagaatttcaaattggtatctgtttagaacttctattgttctgctcttacctttaacataaatcgctctttttaaacatttttaattatagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442629 - DNA, 6793 bp, Homo sapiens
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagtattgcctaagtgtaatcttgaacatgggcggtgctgtgagtgctggtgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggaaaaatgga

SEQ ID NO: 442630 - DNA, 4590 bp, Homo sapiens
  misc_feature (3230)..(3230): n is a, c, g, or t
gcggagtagcaggagtttgcaagctgcttcattaacttggagccagtggaatgtctgggatcgtctgtgatttggaaaccggtggcagaatgttcccgcgtttctggtcctcatcagtcagaaaatgagttccgaggtgagctgttaaatcagaggtggacacacggaggcaaggccagcagctgcaggacctcaagacacctgggcagacactgcaagatgagcttagaaaatgaagacaagcgagctcgcacccgatccaaggccctgcgaggacccccagagaccacagctgcagacctcagctgccccaccccaggatgcacaggctcagggcacgtccggggcaagtactccaggcaccgaagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaagatccttcaagagctgagaagcgtgagatcaagtgtccaacaccaggctgtgatggcactggccacgttaccgggttgtaccctcaccaccgcagcctttctggctgtccccacaaggataggatccccccagagatcttagccatgcatgagaacgtgctgaagtgccccactcctggctgcacaggccagggtcacgtgaacagcaaccgcaacacgcacagaagtttgtctgggtgtcccattgctgccgccgaaaaattagccaaatcccatgagaagcagcagccgcagacaggagatccttccaagagtagctccaattccgatcggatcctcaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacctgtcccacccctggctgtgacggcagcggccacatcaccgggaactacgcctcccaccgcagcctctctggttgccctcttgctgacaagagcctcagaaacctcatggctgcccactctgctgacctcaagtgccccacgcccggctgtgacggctctggccacatcacagggaactacgcttcacaccggagcttgtccggctgccctcgtgcaaagaaaagtggagtcaaggtggcacccaccaaggacgacaaggaggaccccgagctgatgaagtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggagtttgtcaggctgtcccagagcaacctttgctggaaagaagggaaaactgtcaggggatgaggtcctcagtccaaagttcaagactagcgacgtgttggagaatgatgaggagatcaagcagctgaaccaggagatccgagacctgaacgagtccaactcggagatggaggctgccatggtgcagctgcagtcccagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgntgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaaaaaaatgctgtgg

SEQ ID NO: 442631 - DNA, 1603 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttacgtaagtataccaatctttacttattttatcttttagatcttttctctctggttagattttaaaaggaaacaaaatttacaacaaaccttttgatattaaaaagcaccactcccatgctgaaactgtaaaattctacaagcaatttcaggcattataaaaattataatctatttttaacctatttcaggtaattttagccgtcttttaaatctacaaagagctgttgccggtcacaccattgaaagccgaggacgcacataaaagggagctcattttgccatgtgggagacttagcctatttgcccgcctccactgggaggggcttacagaaagagccatcagccagagggctcctacagagtcatggggcttctgctccccagggcgccaagcgcctgctgcctcatgggtagacaaggttagagaacacattccagctaatctgctggggtgtggataggagactttccgtggaaccttacacagccgagcctttgtgtttcactatttcaggatgcaaactgagcaaggaactgataccagggccagcacgacagcaaaacctcctaatgttttaaaatttaaacggctcacacagaaatgagagttccaattgattttatttaaaataaaactatcaggatgctctctgatcatttagaaaatttggaaaatgcaaaaaataataggaagggaaaagttttgcatagtcttaca

SEQ ID NO: 442632 - DNA, 1171 bp, Homo sapiens
aggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaaggtcagattcccttcataactgacatttctgcacactgtgtgccaaggtctgttctgggcagtgtacggatacttactcttttaacaatttcctgcatttcacaaatgaggaaacagaggcagggacaggtgagggagatgcagggtcacgcacatgccctagctggggccagaagctgactcaggtgggtgcttcagagcctgcacgtgaaacgcttttctccaccttccttctctgtctctctctttttccttcttctgtcccttccccctcacctccctcttccttccccttctccttccccccagctgttctgagttttaattctaattgttaatctattataattgttctgctgttagaattatatataaaatagagtcattctattctcatcattagtctaatt

SEQ ID NO: 442633 - DNA, 1104 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442634 - DNA, 1174 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442635 - DNA, 1069 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442636 - DNA, 1112 bp, Homo sapiens
tggagatggagtctcgctctgtcacccagacgagtgcagtggcacaatctcagctcactgcaacagcctggagaacagagcaagactccgtctcaaaaaaataaaacaaaactgaaaatcatggcagaggaatcaagtgccccaaaactacttctgtgtgcatagcaattaactgccagttacgatacatggccctttaatattgaaattgaaggttaagcttttaccttttagcagagtagattcataaggaatgtacttttgtcatgtttatagtaatgttcagttacggtacattttatacaaatccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442637 - DNA, 1248 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcaggagcggatgtcggctgacttggctgggttcctgagggaccgggggtgcggacgctcagctgcgcagcttcctgctttaggttgacccccggagcaaaaacgtcggatatgaagcccttcggtgcattaaatgtctctcaattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442638 - DNA, 1048 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442639 - DNA, 1189 bp, Homo sapiens
tggagatggagtctcgctctgtcacccagacgagtgcagtggcacaatctcagctcactgcaacagcctggagaacagagcaagactccgtctcaaaaaaataaaacaaaactgaaaatcatggcagaggaatcaagtgccccaaaactacttctgtgtgcatagcaattaactgccagttacgatacatggccctttaatattgaaattgaaggttaagcttttaccttttagcagagtagattcataaggaatgtacttttgtcatgtttatagtaatgttcagttacggtacattttatacaaatccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaaggtaagcttttttggctcaatagtacatttggccagtgatgctatatgaaaatctattcataaatcctttctcctcagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442640 - DNA, 831 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442641 - DNA, 1125 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagtatagagatgaaaaaaaagtttg

SEQ ID NO: 442642 - DNA, 1255 bp, Homo sapiens
tggagatggagtctcgctctgtcacccagacgagtgcagtggcacaatctcagctcactgcaacagcctggagaacagagcaagactccgtctcaaaaaaataaaacaaaactgaaaatcatggcagaggaatcaagtgccccaaaactacttctgtgtgcatagcaattaactgccagttacgatacatggccctttaatattgaaattgaaggttaagcttttaccttttagcagagtagattcataaggaatgtacttttgtcatgtttatagtaatgttcagttacggtacattttatacaaatccagaaagactgactctatgcttatttaaaaatgcaagaatataatgaaaaagtactaagattcccaattatttgcagttccaagtataattgtgaaatgccatctttcataacttattagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaactttttttttttaagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442643 - DNA, 1209 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442644 - DNA, 875 bp, Homo sapiens
ccccacaccccccccccccccacccccccccaacttaaggctaggtacgagctggtggtgcagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442645 - DNA, 1421 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcaggagcggatgtcggctgacttggctgggttcctgagggaccgggggtgcggacgctcagctgcgcagcttcctgctttaggttgacccccggagcaaaaacgtcggatatgaagcccttcggtgcattaaatgtctctcagtaagaattttggagaccctgccaagaagtgaccctggtcactatgttggtcaggctggtctcgaactgtaagcttaagtgatcctcctgcctcggcctcccaaagtgctaggattacaggcatgagccactgcgccgggccggctttctccacatcgaatctttcctgccagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442646 - DNA, 1286 bp, Homo sapiens
ccccacaccccccccccccccacccccccccaacttaaggctaggtacgagctggtggtgcagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaaggtaagcttttttggctcaatagtacatttggccagtgatgctatatgaaaatctattcataaatcctttctcctcagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442647 - DNA, 982 bp, Homo sapiens
tgtgcccatcacttccggtcgcgccagccgcccgttgccagttctgcgcgtgtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggaggcaagtatggatgacccttactttttatatgtaacttaagccttactctaccctacccatgcgatacataatttaagaatagaatacatctgaagcaaaacagaaaaggcatgactttaaaagaacaactttttttttttaagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagta

SEQ ID NO: 442648 - DNA, 1127 bp, Homo sapiens
agaagtattgcgccgttggtgattacggaagaaccaggagtttggcgtgaccatggtgagagaagacggtccaagaagggacgttatcaggccactttttgggtggagaaggaggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagaactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442649 - DNA, 1635 bp, Homo sapiens
agaagtattgcgccgttggtgattacggaagaaccaggagtttggcgtgaccatggtgagagaagacggtccaagaagggacgttatcaggccactttttgggtggagaaggaggtagtcagaccgtggccaaatttccttcacattatcctagcatattttcattctggtcttagctcttaaacttctccaagcggtgactgttatgctttacagagtggggaagagggtctgggttatttgaggcaagaagggaaggcaatagacaagagaaaagaagagactttaaaagatgccgtgtgtttccaacttttttaattctaaaatttctgtttcaaggggaagcaaaagaaaacaaggaagtatgcgaccatgaagcgaatgcttagtctcagagatcagaggctgtgagtgtctggaatcaactgcccagggatattctaataagagtctagagaggataagtagtaaaaatgtttgttgttattattttgttttttgcttattatcgtgtcttagatttatatagcatgagatagccagtgtttaacagtaatttagctgctgagcgatcacactgggaaaggcgttgggaattaaacatttcttaagtgttcactttttctaccgttatatgctttgtctgccatatcgcatttaaacctcatgtcagttcggtgaagtccgtatagttctctttatgtttttaccattacactactacattcccctggggtggggcgaggggagtgtttcttgttgaaagatggcaaggttagagaccttgtttgtctggcgtttccagtgcctggtactcaaatatttttgtcagagaaaatgggaaaactccaagatatctccattttataagtcttactaatataagaatccaaatcactgtggaagaagaaagtgaagtgaaattccctagtatgaagaggatcaaagcggtgtccctgcttaagtgtagaataagcatagctattaaataaagactgatcttcactgagtttaagagtctcagaaagccgggcgcagtggctcacgcctgtaatcccagcactttgggaggctgaggcgggtggatcacctgaggtgaggagttcaaaaccagcctggccaacacggtgaaaccctgtctccactaaaaacacaaaaaagagtctcagaataagagaatagtcgttaaaaccttcagaattattattctcagcctttagtgtggatgtattgtgtaatttttaggaatgacactccattaataataatttctttctagttaagggttaagttctgtatatgcgtttttacattttagccctttataagaagcatatggggtaatacttttcccccaaaagttaaagcatctgaatcttcagaagataactgtcacccttttacccattgcttggaagtggattgtgatccttgatgtgagagattctgactaaaaaataaatatagtataatcagcttttatttactcattaacaattcttatgcattattggcattactggttaattctgatacttccaggtactgtgctttgcactagagttatttgctcagaaagagtatgctgatattaacatgaggatatcacaaagtaggatttcttcagtagaccaa

SEQ ID NO: 442650 - DNA, 1667 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggtagttcaatatgctcactctttttttttttttttcttgagatgaagttttgctcttccagcctgggtgacggagtgagactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442651 - DNA, 1653 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggcaggagaacctcttgaacccaggaggtggaggttgcagtgagctgagattgcgccactgcagcctgggcgccgagatagcgccattgcattccattccagcctgggtgacggagtgagactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442652 - DNA, 958 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccataggtgagaaatttcccttggagaagggaatagaaatatataattgatatcaattgaaaatgaggataagtgataaggttataaaggatttgaaagaaattattgtatcaaatgtttacatagttatatttgaagaaatgagacaaagcaagagcaagagcaaaagagagagataggatttaaggaatgaggcaaacatttaaattgttagagtaagattactggaagaaatagacgtattgttttaaataaaagcagtaatttaaatcaagctaatctttttggccagaaatacctgttttgaaagatttttttttattaacacttcatctgagaaatggaaagcttatttaaaaaaaaa

SEQ ID NO: 442653 - DNA, 649 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcaggtattatcagttcataactgtttactttgtgcttaaaaaaaaaaaatgtaaactattatctcctgaatgttcatggtcagtaaaacatctaggaatatacattatggttaaattaaaaaaaaattgcatagcattccttcataa

SEQ ID NO: 442654 - DNA, 1707 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggcaggagaacctcttgaacccaggaggtggaggttgcagtgagctgagattgcgccactgcagcctgggcgccgagatagcgccattgcattccattccagcctgggtgacggagtgagactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442655 - DNA, 1367 bp, Homo sapiens
agaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacttccagcctgggtgacggagtgagactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442656 - DNA, 1639 bp, Homo sapiens
gacggaagaaccaggagtttggcgtgaccatggggaagcaaaagaaaacaaggaataaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggcaggagaacctcttgaacccaggaggtggaggttgcagtgagctgagattgcgccactgcagcctgggcgccgagatagcgccattgcattccattccagcctgggtgacggagtgagactgtctcaaaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttagaaatcag

SEQ ID NO: 442657 - DNA, 1279 bp, Homo sapiens
gtccgacccctaataatgagagcccactggacataactacggggtaagtatcctcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcgtcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgaaaaaaaat

SEQ ID NO: 442658 - DNA, 2179 bp, Homo sapiens
agatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcgtcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgaaaaaaaat

SEQ ID NO: 442659 - DNA, 2358 bp, Homo sapiens
agatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatgggctgctgacaccagctaatggacattaaaacatgtcaggaggaacttaaattactaacgatttcaagaacaaggggtggtaattctggcacagtgtcagaaactcatcaactatagactgttcaatcattattgcctaggcgtccaactatggttttgcacctcaacataccaaagagtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcgtcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgaaaaaaaat

SEQ ID NO: 442660 - DNA, 1661 bp, Homo sapiens
agttccaagtagcataatatactcaggagtttaaaatcatttaacattcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcatataccctggaccaaagaccgctcctcctctattggaggtggtcgtcctcttcgaccaagcgcacagcttcaggagggacgcacatggagcggtgagggaagaaggggacaccacctagccatccagatcagctaaccaaccctggtgattgatggagtgacagatggtgcagccacatcaccctcacatccaaaaaaataggtgtatttgaaaaagaaccaaaaagaggccgggtgcagtggctcacacctataatcccagcactttgggaggccaaggcaggcggattatttgaggtcaggagttcaagcccagcttggccaacatggtgaaaccctgtctttactaaaaatacaaaagtcaattgggtgtggtggcacatgcctgtaatcccagctactcaggaggctgaggcataagaatcgcttgagcctgggaggcagaggttgcagttagccaacctccgcctcccaggctcaagtgaggcctgcaccagagtgagactctgtctttaaaaaataaaagagtttgtagaacttaaaagtataatcattgaaattaaaaattcatttcaggccgggtgcagtggctcatgcctgtaatcctagcaatttgggaggccaaggcaggcagatcacttgaggtcaggagttcatgaccagcctggccaacatagtgaaaccccatctctactaaaaatacaaaaattagctggaaatcacttgaacccaggaggcggaggttgcagtgagccaagattgtgccactgcacaccagcctgggtgacagagtgagactccatctcaaaaaaaaaagaagaaattaaaaattcagtggacacgttaaacagattaaatgcagctgaagagagaattagtgaaatggaagataaatctagaaaattattcacagtgcaacacagaaaaatggaaaagtagaaaatataagggaaagttgagaggcgtggaggttacagaggagagttctagcaaaagataattaagagaatggggcaaaagcaataactgaagagataagagcacagcattttccagaatcaaagacataacatttttagattaaggaaacacagtaaatcccaaactggataaaagcattattttatttgcaaatagcatgattgtgtatgtagaaaatcctaatgaatctacaaaaaagctactagaactaataatttagcaagatcacaagaatacaaggtcaacatacaaaattaaattgtatttctatatatatgcagtggacaattggaaaaatgatttttaaaatcaaataccagctggatgcgtacttcacgcttgtaatcccagcactttgggaggccgaggtgggtagatcacttgagcccaggaatttgagactagcctgggcaagatggcaaaaccgtctctacaat

SEQ ID NO: 442661 - DNA, 1235 bp, Homo sapiens
ctcaaaaaaaaaaaaaaaaaaagaattgagtaagtggaattttgactggagctgctcctgaaagtattgaaagagtcattgctaatggtgggctcttgctagaccagggtcaagtccacttttgctgcctctcaggttgtggaattctccttgatcacttctgcaattcatttccttgccaaatctcagccaagcatcaccccaaggtctgtaagtagcagagatcggagctgctgggtctggctttgctgaggccggtgtcgctgtcagaacaggcacgccaagatcttggctgggtccctcacaggccagatgaatggtgtgaagaaaccttcctgccttattcagactggcgcggaggtctcaatgaggcgaggcatttgtccattatggggatgaatcgtgctctcagaagagaatcctgtcattgaggttttgtttcaatagtcctctctttttctccagagaactgttgtctcattgttaataatagcagcgtggctttttcagatgctggttggtggctgctgtacattttaaaaatggaatctcatggttgtgtctcttaaggaagcttttcaagaactttactggcaccagaggttatcagagtttgaagtttgggtgcctagtgtctcacagtgtttaagcactaatgttctgggtcagttaggtgtgagtacaaatcccatctcagctcattctgagagggaccttggctaattgctttctcctctccaagcctcagtttccacatctctaaaatcggcctgcaagtagtgtgtgcctaaggttgttgtaagtttcaatgaactcgaatgcggctgagtgcctgagagcacctgttgctgtgggtatcatcaccgtgtgtgttttctgtcttctcatccacttttctttgtgcagtctgcacacacaccattaaaggctgatgacagcatttttacgaattgcaaacagaggccagcgcggtggctcccagcactttgggaggccgaggcaggtggatcacgaggtcaggagttcgagaacagcctggccaggatggtgaaaccccgtctctactaaaaatgcaaaaattagctgggtgtggtggcatgccccctgtaatcccagctactcaggaggctgaggcagagaattgcttaaaaacccaggaggtggaggttgcagtgagctgagaatcgtgccagtgcactccagcctgggtgacagagcaagatcttctgtctcgg

SEQ ID NO: 442662 - DNA, 1227 bp, Homo sapiens
  misc_feature (1199)..(1199): n is a, c, g, or t
ctcaaaaaaaaaaaaaaaaaaagaattgagtaagtggaattttgactggagctgctcctgaaagtattgaaagagtcattgctaatggtgggctcttgctagaccagggtcaagtccacttttgctgcctctcaggttgtggaattctccttgatcacttctgcaattcatttccttgccaaatctcagccaagcatcaccccaaggtctgtaagtagcagagatcggagctgctgggtctggctttgctgaggccggtgtcgctgtcagaacaggcacgccaagatcttggctgggtccctcacaggccagatgaatggtgtgaagaaaccttcctgccttattcagactggcgcggaggtctcaatgaggcgaggcatttgtccattatggggatgaatcgtgctctcagaagagaatcctgtcattgaggttttgtttcaatagtcctctctttttctccagagaactgttgtctcattgttaataatagcagcgtggctttttcagatgctggttggtggctgctgtacattttaaaaatggaatctcatggttgtgtctcttaaggaagcttttcaagaactttactggcaccagaggttatcagagtttgaagtttgggtgcctagtgtctcacagtgtttaagcactaatgttctgggtcagttaggtgtgagtacaaatcccatctcagctcattctgagagggaccttggctaattgctttctcctctccaagcctcagtttccacatctctaaaatcggcctgcaagtagtgtgtgcctaaggttgttgtaagtttcaatgaactcgaatgcggctgagtgcctgagagcacctgttgctgtgggtatcatcaccgtgtgtgttttctgtcttctcatccacttttctttgtgcagtctgcacacacaccattaaaggctgatgacagcatttttacgaattgcaaacagaggccagcgcggtggctcccagcactttgggaggccgaggcaggtggatcacgaggtcaggagttcgagaacagcctggccaggatggtgaaaccccgtctctactaaaaatgcaaaaattagctgggtgtggtggcatgccccctgtaatcccagctactcaggaggctgaggcagaagatcccgctccgtcacccaggctggaggcactggacgacctcagctcactgcaacctccnacactcgggtctttaagcaattctctgg

SEQ ID NO: 442663 - DNA, 1185 bp, Homo sapiens
cggcacgagccccaaacccactccaccttactaccagacaaccttagccaaaccatttacccagataaagtataggcgatagaaattgaaacctggcgcaatagatatagtaccgcaagggaaagatgaaaaattataaccaagcatcaccccaaggtctgtaagtagcagagatcggagctgctgggtctggctttgctgaggccggtgtcgctgtcagaacaggcacgccaagatcttggctgggtccctcacaggccagatgaatggtgtgaagaaaccttcctgccttattcagactggcgcggaggtctcaatgaggcgaggcatttgtccattatggggatgaatcgtgctctcagaagagaatcctgtcattgaggttttgtttcaatagtcctctctttttctccagagaactgttgtctcattgttaataatagcagcgtggctttttcagatgctggttggtggctgctgtacattttaaaaatggaatctcatggttgtgtctcttaaggaagcttttcaagaactttactggcaccagaggttatcagagtttgaagtttgggtgcctagtgtctcacagtgtttaagcactaatgttctgggtcagttaggtgtgagtacaaatcccatctcagctcattctgagagggaccttggctaattgctttctcctctccaagcctcagtttccacatctctaaaatcggcctgcaagtagtgtgtgcctaaggttgttgtaagtttcaatgaactcgaatgcggctgagtgcctgagagcacctgttgctgtgggtatcatcaccgtgtgtgttttctgtcttctcatccacttttctttgtgcagtctgcacacacaccattaaaggctgatgacagcatttttacgaattgcaaacagaggccagcgcggtggctcccagcactttgggaggccgaggcaggtggatcacgaggtcaggagttcgagaacagcctggccaggatggtgaaaccccgtctctactaaaaatgcaaaaattagctgggtgtggtggcatgccccctgtaatcccagctactcaggaggctgaggcagagaattgcttaaaaacccaggaggtggaggttgcagtgagctgagaatcgtgccagtgcactccagcctgggtgacagagcaagatcttctgtctcgg

SEQ ID NO: 442664 - DNA, 2177 bp, Homo sapiens
aagatttgttttgcaaggtttgtggagagctgatgcggtagtgaggctaagacgaggggtatttacttgctacttacattgagtccactaacatctgcagcactttgcttgcattatccacgcaattatcacgggaaacctataaaataagtattcctctcctcattttacaaatagggaagcagataagatttagaaaatttcccaaactcacacaattattaaatgacagaactaggactcaaacccaggttttattaattttagagacatgtttttaaccacttggacactgccaaccatggaattgttggtatgaaaaaaacgtactcttgagttatattatccatggtcttaatatcagagaagtgcagttgagtcgctattaaagaatatggtaaaattataaaatggatactatacaaaggtataaaaatattataaatacttatgtttggggtaaaaggatcaaagtagccatgctcagtggaagggtaaggaactcttagcagagattgattaattgggagataattgattaattgggagttgattgattaattgggatttattaatttgggagtaggtaggaagataggaagttgtataaaataagggagagataacttagtacctggaaaaaaagaaatggaaataggtagaagctaagagttcaattaaaaaaaaggaataaaagatattggaagggaacgatgaatgtagcatggaagatccaagatgatgggagttcaggggctaattacagctatggggaaaaagtaatgtataagctggaagccagagataagagccatgtaaatgaagaagttgggccccaataggaaagaattataaggactagaaggagcaggagccatgtggaaaaatatcatgtagtacttttaagcttgatctgtcatctgtagcaaaaccagcatgcttgagtactgaattgacctgactgaactatgttgaaatgtactgtggttttatatccatatgcacttggtctgtggagttgtgggaaaagcatcagtgagtaggaagcccaaggatttgggtcaagtattaaatatgctatttactgtctagctatgtgaccttatataagtcacttgtggtctctgagccttcatgtattcatccataagatgagttgttgtttatattaaatgggatgtggtatgttaaagagctgaatgcatagtgatacagaattactttctgtaatactattttttaaatattttaaatgaaaaattaatgaacttataaattaaaagattcaaaagggataaaaaggtatacaatgaaaagcaattctccttcccaccagtaactctgtcctactccttaggacattcaccataaacagatatcctgaattcttctagaaatattatatataaaatcttatatttcttatgtttcttttttactattttaaaggggataaactaaactttgctttttttcatataataatatattctggagatcattttctaaaagcacatgtaaacatacctcattattataaaggtttgaaaatatcaatttatttgacctgtcccctctcgatagataattagattgtatccatccctttggttattaccaacagacactaatcacttatcatgtacatatagcctgttttttagcattgttagacaaagtaggcatattcctttccatccaagaactcataacctagtaattgtagttggctgatagctcattgcccatacacaaggatctaacacaacctcttgaataaacatcccccttattcagaaatgccttttcctatttccatattgcaactttgcttacaaatttccaatctgtctttctgtttacagaagatatacaaaattccttttgtatgatctctttatatctcttgattttcttttgtgtttgctaccaaagggcctgcacatagtgagaagattgtgcatgatctgtgagctctaccacacctggaattaggaatcaccaatatgagaaaaaaaattggaggtacaaataacattatcatatgtaattggcatataaattacagatgtatctatgactaaaaaccctgtggatataaaccaaatgcagataaatataataaaatatataaaaatataatcaaataatgatagtgctattcaaatacttcaaat

SEQ ID NO: 442665 - DNA, 1321 bp, Homo sapiens
  misc_feature (48)..(48): n is a, c, g, or t
  misc_feature (50)..(50): n is a, c, g, or t
ggctcctggctcctgtttgacaagttactgttacacgtgtttgtttantnacagactctttctcaaaagtataaggcgaagtggtaacagtaacttgtcaaacaggagccaggagcagagaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442666 - DNA, 551 bp, Homo sapiens
ggcgtggcgtgacccggaagtcgacgaggggttccgccccccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatga

SEQ ID NO: 442667 - DNA, 2613 bp, Homo sapiens
ggcgtggcgtgacccggaagtcgacgaggggttccgccccccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442668 - DNA, 963 bp, Homo sapiens
  misc_feature (817)..(818): n is a, c, g, or t
ggcgtggcgtgacccggaagtcgacgaggggttccgccccccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaattgnntcatgagaacgttctggatctggggattggggatgaaatcccaatatggttggccgaagtcaacaaggggggtgccaggaaagaagagtccaaaaaggaaggaagggtgagagaaagggtaaaaatttagggtggaggaaaaaag

SEQ ID NO: 442669 - DNA, 2563 bp, Homo sapiens
gaccggcccgcggagccccctttttggggcccttggcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442670 - DNA, 2509 bp, Homo sapiens
gaccggcccgcggagccccctttttggggcccttggcagtccttcgcgccctcctcgccctccccaccgacatcatgctccagttcctgataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442671 - DNA, 2397 bp, Homo sapiens
actatctgaaccaaaagcagtagaatcagtatatcctgaaggcagtgctggaggcagtctcatgcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442672 - DNA, 2004 bp, Homo sapiens
  misc_feature (9)..(9): n is a, c, g, or t
tgccagcantatgattcttttgagaaggaaaaaagtcagatcaaatacatcattaaggaaaaacatgcacactaaatagactatgaactctactgggacaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442673 - DNA, 421 bp, Homo sapiens
gaccggcccgcggagccccctttttggggcccttggcagtccttcgcgccctcctcgccctccccaccgacatcatgctccagttcctgggtgagtggagctgccgaagagcggggcccgctgcctggggcgtgcctcggaccccatttcccccttgaggattgccgaccccgccgacccggcctgggcgtgggtccagcggtcccttcgtcccccgcgcctggtcgtcgcctcgcagggcggccgttttcttcctgcctccccagaaaatccctttgccaatatttttctgcagccatccaagtccctaaaactttgaggtgtcagagagtgtgcgtttccagagcttcttattgtgtgccgcgccccgcgctcattgtgcaatctttgtattaaagcttgtgtggtccttgatgaaaat

SEQ ID NO: 442674 - DNA, 501 bp, Homo sapiens
gaccggcccgcggagccccctttttggggcccttggcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatga

SEQ ID NO: 442675 - DNA, 2620 bp, Homo sapiens
aattcgcggccgcgtcgacacggctgcgcagaagacgacagaaggggccccgcgcatggggaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442676 - DNA, 2749 bp, Homo sapiens
aattcgcggccgcgtcgacacggctgcgcagaagacgacagaaggggccccgcgcatggggaggtaggctcggaccggcccgcggagctgctgcagtccttcgcgccctcctcgccctccccaccgacatcatgctccagttcctggtgctgggatttacacggggcaacgtggtttggaagtgtatcgtggctcagaacctatgtatatacccaaaaaccggtgggtctttaaaaaaaaaaaccttttgcaagaaggaaaacacttttttcaaccacacgacgggggcacccttgtggcgaagtttggccccataagggaagacgggaaaaaagccgctcccttaaaggtgggccatttgacgcacctggcccttcccaggcaactgtggcccttttaccagggggacttacttacctgtggattttcataaccgtgggcctccttttggcagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagtttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgtatagtaaaatcagcagctcaagaagaatttctgcttctctttgtagttgatgctttgttttttcctgcagtcagaaattccttgtatttgtcaaatgtataatcagcttgtattgtttttaaattaaaaaaaaatttgaataattaacttttgccatgggacaagatacaaaagtaatttcatataaagggcctctcccacccctgttctctggctcctggctcctgtttgacaagttactgttaccacttcgccttatacttttgagaaagagtctgtgcctaaacaaacacgtgtaacacaaatagtaactatacatggaggtctagccctcgccttttttttttctttttttcttttttaatggagatcattctataccagcatgtaagtagcaaggaacctcattctttttttggctgcctaaaatttttttgaatagatataacataattgatttaatctgctactggtgaatgcttaggttgttcttttgctattacagtgataacttcaatcctaatgttattaagcatatcgattcagggtatagctataagatgaagtcctaaaagtataatttagactaaatacaaatacccatttcgctagctgttttgtttcagaggacttgttgagcagcttcactaataatgccatttttgaagacatggcaggttcagaatcaataaactggaagaattgttcagagcatcttttttcagacagtgatgacattgattctgtatatgataaagtgattctgcttctctttgacaacttgcatctctcctacatggaagtaagttttattcctgtcaatgttgtctttgtgtgtgacagattaggattaaattatggtttgacttttcctagcagcgtgatccatgggcaagtggcttatttttttttttttttttgagacagagtctcactctgctgcccaggctggagtgcagtggcacagtcttggctcactgcaactcctgcctcccggtccaagtgattctcgtgctgcagcttctcaagtagctggcatcaccaccacacctggctaatttttgtatttttagtaacgacgaggtttcaccatgttggcaaagctggtctcaaattcctggcctcaagtgatctgcccacttcagcctcccaaagtgttgggattacaggcgtgagccactgcgcccggcttttttaaacttttagattcatttaataggtaaattgcatgtcacgggtttgtagcttattctttcagaaactcttgcattatctgtagacgtggacgtaaatatccacctcatagggttttcataaaaaataattgagataatgtatgtaatgtttcacagtgctttgcagactatctaataaatagtagctattagtacaaaaaaaacaaaacaaacacacaaacaccaaaaaaaggggggggggcaaaaaaacccgcgggggggcccatagcgccccgtttttgacaaaggggcc

SEQ ID NO: 442677 - DNA, 4062 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442678 - DNA, 2495 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggtcccacgcgcgtctttcccacgcacgtctttcccacgcgcgactttcccacgcgcgactttcccacgcacgtctttcccacgcgcgtctttcccacgcgcgtctggcactcgctttgtttcagaactcgtttgtagggtgcgccatccaggcttgcttttgtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagcataaaaaaaaa

SEQ ID NO: 442679 - DNA, 4008 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442680 - DNA, 4033 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442681 - DNA, 3037 bp, Homo sapiens
ttagtatgtctcaagtagaaaaggcatgaaaagtcatgtgaactttagattgtgtagccggcaattttttgctactttttgtttctgaaaaattcctcagcagtcctaaagagaagagtgactcacacacttgtgtaaagccagggttggagtctggacctcctggtttctgaatcatgacatgttactgctgcttctaggtccaaagtggtattaactgtaagaaaacaaatgctctttatctcaattacttgggcgtctttggttggtgagaagtgactggtgtgtactatgagtgtaaatgtggatgtttttgtgtattttcctccatttctcccaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442682 - DNA, 2751 bp, Homo sapiens
aacttgtttttgttatactttagttttaaaagtttaggaaatacatagttcaatttagagagatttctgtgtttcatacaagttttattgtataaataggtaagactccctgtgtctggagaacttggctttctagaataacttactctttgatgttgctgttggttaatattttgccataaatatcactcttgaacatttccatgcccctttgctttcagttttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442683 - DNA, 1505 bp, Homo sapiens
accatgataaacgacatatcatgaataagttgcaactacgctgtctcactgcggactaaccccagctcactgtccctaattggtgggtgagagcaatgcagggcttggatgaatgctgcgttcacattgaaggagtgccaactagaggggttctgtgctcgaattctgtcccatggtcatagtatgtgacctagttgtttaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442684 - DNA, 1583 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaagtaaggatcggtgttcggttctgagacttggatttaaaaagcatgggcacg

SEQ ID NO: 442685 - DNA, 218 bp, Homo sapiens
gtatgatgatgctggtggggtggtgatgatggcaatggtgtgatgttgatgatgatgtgaggatggtgatactcatggtaacagtgatgttgatgacgtagtgattgtgatggtgtgatgatggggatgatggtgatgtgatgataatgatgttggggatgggtggtgatgatggcgatgatgaatgcgtggtggtggcagtgatggtggtgatgatg

SEQ ID NO: 442686 - DNA, 501 bp, Homo sapiens
ctggatattagccctttgtcagaagggtagattgtaaaaattttctcccattctgcaggttacctgttgactctgatggtagtttcttttgctgtgcagaagctctttagtttaattagatctacaggggatatcatcttaaaggatcattctctaaagtcactacacttcatgaaaactataccatatatattttttccattcctcttctgcaaagttcatgctttttgtactaaggaacaacacttttttcatattattaaaatatatattgtggtgattaagatgattagaagattattgacaaaacctgaatttaaatcttgtagcaccccacctgaactttatctaaacgcattatacctttccacttaaaatcagtcaatgtgtaatgagtgtgtcgtgctttaattatatttctcctccaaacagagcttttgtgctgccttgcaccaggaactcagagaatactatcgattgctctctgttttacattctcag

SEQ ID NO: 442687 - DNA, 2773 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgaggttgagatgtgcctatactgcgtttgaagtcccgagaaatcactgacagttgtaaagagggaggggccaccctcactggcatcatcatcctgtttcacaaaataaataaaaacagcagcattcatgag

SEQ ID NO: 442688 - DNA, 3926 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaagtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442689 - DNA, 4032 bp, Homo sapiens
actgtaactgccgtgttttcctactgtttaaagggttgaaggttggatttgatataaaactattctgggaaagttcacatggcgaatattgttactaataagcaaaactaatcctatacgagcattgcttttcaactagagccatgcattggaatcgcctgtgatttcacaagaacctgataacgttgattgcctgtgggaaggggagctggtggccagtggttgagaacaggactttttatgctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442690 - DNA, 2596 bp, Homo sapiens
ccgtatccccttctctccgggaccttgtcatgttgcgagacacagcttgaggacacttaccacgaattttttgtagcatcagatccaacagttaaaacagatcgactgtggcacgacaagtatactttgaggaaatcgatgattccttcgtttatgacgatggatcagtctaggaaggtccttttgataggaaaatcaataaatttcttgcaccaagtttgtcatgatcagactcccactacaaagatgatagctgtgaccaagtctgcagagtcaccccaggacgctgcagacctattcacagacttggaaaatgcatttcaggggaagattgatgctgcttattttgagaccagcaaatacctgttggatgttctcaataaaaagtacagcttgctggaccacatgcaggcaatgaggcggtacctgcttcttggtcaaggagactttataaggcacttaatggacttgctaaaaccagaacttgtccgtccagctacgactttgtatcagcataacttgactggaattctagaaaccgctgtcagagccaccaacgcacagtttgacagtcctgagatcctgcgaaggctggacgtgcggctgctggaggtctctccaggtgacactggatgggatgtcttcagcctcgattatcatgttgacggaccaattgcaactgtgtttactcgagaatgtatgagccactacctaagagtatttaacttcctctggagggcgaagcggatggaatacatcctcactgacatacggaagggacacatgtgcaatgcaaagctcctgagaaacatgccagagttctccggggtgctgcaccagtgtcacattttggcctctgagatggtccatttcattcatcagatgcagtattacatcacatttgaggtgcttgaatgttcttgggatgagctttggaacaaagtccagcaggcccaggatttggatcacatcattgctgcacacgaggtgttcttagacaccatcatctcccgctgcctgctggacagtgactccagggcacttttaaatcaacttagagctgtgtttgatcaaattattgaacttcagaatgctcaagatgcaatatacagagctgctctggaagaattgcagagacgattacagtttgaagagaaaaagaaacagcgtgaaattgagggccagtggggagtgacggcagcagaggaagaggaggaaaataagaggattggagaatttaaagaatctataccaaaaatgtgctcacagttgcgaatattgacccatttctaccagggtatcgtgcagcagtttttggtgttactgacgaccagctctgacgagagtcttcggtttcttagcttcaggctggacttcaacgagcattacaaagccagggagcccaggctccgtgtgtctctgggtaccagggggcggcgcagctcccacacgtgaagctcgcggtcctcccagggagctgcgggtgatgttcgttgcactgctagacacgaaattcccattgacgtcctgcaggaactgcatgctgcaggtgtcctgcccttccgcccacgagtgcgccatgtttcagcggagcggcgtgtgggagaagccacgtcgtgtttcacatgtcggagtcgaatgcatttgtaaatccctaagtcaagtaggctggctgcactgttcacatttgtctctaaaagtcttcatcgctaaaagataccataatttgctgaggcttcttaagctttctatgttataatttatatttgtcactttaaaaaatccatttcttttagaaaaaattagggtgataggatattcattagttaagatggtaacgtcattgctatttttttaacatcctctttagaggtaatttttgttaacataaccaaaaattaaattgaaacaaaatgtcccaactaagaaaatatatagagcattttatttttttttagtgttgtaaaatattaacctctgtgagatcctttgtatcttaatgcattacctttacacatatttattcttattttctctcctttcagagtttacatttttatatttaatttactatttcagatttttaaaatagtatagaaaaaagtaggagtgatagagaacaaaaatactcttatacagtgcaacccaaataccgcgaatgcatcagctaaagcagcgtgtaaataggagtgatgagaaagttaatggagtattttattttcaaagttcctgataagcattggaaagaaatcgacatggataatgaagatttcctttttccttgcctattttttcattgtaaatatttatatactactgaccaagatgttggggtgggggggattgttttttgtaaaaatgtcattatcaggtcacataaatctgcctttatgttgcataagtgaaaatttagaaaattaaaagcaattatctttcaaaaaaaaaaacagggggggttaaaattccgaggggcaggtaggtaccagtttgtaaagggcctagggggttaagaagagggggggtaaagggggggaaggtgattggagacctctggggaatggaacacaaaaggagaatgtattgaaatcgtgatgta

SEQ ID NO: 442691 - DNA, 2510 bp, Homo sapiens
agcggggcattgtgggaagcgcccgcgctttcggcgggttccgttaaaatggcgccctggtggccggcggcgcccgcgccttagcctgtcaggagcagggagcttgcggggcgcaggaagggcgcgggccgcggtccctgcgcgtgcggcggcagtggcggctctgcccggaccaccgtgcacggctccgggcgaggatggcgaccccggaccagaagtcgccgaacgttctgctgcagaacctgtgctgcaggatcctgggcaggagcgaagctgatgtagcccagcagttccagtatgctgtgcgggtgattggcagcaacttcgccccaactgttgaaagagatgaatttttagtagctgaaaaaatcaagaaagagcttattcgacaacgaagagaagcagatgctgcattattttcagaactccacagaaaacttcattcacagggagttttgaaaaataaatggtcaatactctacctcttgctgagcctcagtgaggacccacgcaggcagccaagcaaggtttctagctatgctacgttatttgctcaggccttaccaagagatgcccactcaaccccttactactatgccaggcctcagacccttcccctgagctaccaagatcggagtgcccagtcagcccagagctccggcagcgtgggcagcagtggcatcagcagcattggcctgtgtgccctcagtggccccgcgcctgcgccacaatctctcctcccaggacagtctaatcaagctccaggagtaggagattgccttcgacagcagttggggtcacgactcgcatggactttaactgcaaatcagccttcttcacaagccactacctcaaaaggtgtccccagtgctgtgtctcgcaacatgacaaggtccaggagagaaggggatacgggtggtactatggaaattacagaagcagctctggtaagggacattttgtacgtctttcagggcatagatggcaaaaacatcaaaatgaacaacactgaaaattgttacaaagtagaaggaaaggcaaatctaagtaggtctttgagagacacagcagtcaggctttctgagttgggatggttgcataataaaatcagaagatacacggaccagaggagcctggaccgctcattcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggtcccacgcgcgtctttcccacgcacgtctttcccacgcgcgactttcccacgcgcgactttcccacgcgcgactttcccatgcacgtctttcccacgcgcgtctttcccacgcgcgtctggcactcgctttgtttcagaactcgtttgtagggtgcgccatccaggcttgcttttgtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagcataaaaaaaaa

SEQ ID NO: 442692 - DNA, 1411 bp, Homo sapiens
cagggaaggtcgggtgtaaattcggacgaggagctggaccgctcttttcggactcgtcgggcagagcttttgtgctgccttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggtcccacgcgcgtctttcccacgcacgtctttcccacgcgcgactttcccacgcgcgactttcccacgcgcgactttcccatgcacgtctttcccacgcgcgtctttcccacgcgcgtctggcactcgctttgtttcagaactcgtttgtagggtgcgccatccaggcttgcttttgtgtcctgcccgtttttgtccttaatggccgtgttgattcgataggaatcgacagatgggagccaagaggggacgtaaccacttgccagtgtggcccagtatttatatggtagaagctcgggctggcattgagatggaggtgggaaagaggagggtgtctcgtgtttaaagatttctctcttgtgtggtccttggttatggctccccatggtgcttgctgctcccttggtcgcctttccttgcattttgctttttgcctttagtccttctgcagtcagggaccatgttggtgactctcggtcagatgttcccatatttgcatgtcttgctttggcctctctggctctaggttctgtattgctagttgctttctgacattttttctcattgtttgtgctaccttggccaagaacctctttgccttctccctcgtttgtaacattgagatcctagtagcagttacttcttagggttgttaggatgacatgagatgggcgagttggccatctgccacacaagagttcccttctcactgccatcctctgcccagggtgttccccagaatctgcagggccccattggtcatcttgctgtctgcacaccttcctctctcacctcttggcacttccctcaaaaaagagagaagtggagcacagtaaataaacgccagcgttttctccagttcccagcacctctccggaactggatcccccaaactcctctgtcactttctgtgtccagcgggcccctggggtccttcactgtcttcactctgctcagcctgtgcgcttggccttggtgctgtagggactgttataagagctgctgtccgatccccatattcaatctcacagccccactttgtgtacacacaccagagccatcttcttaaaatcagatcctgtcactcctctccctaaaatctaccagtggtctaataaaatcttgaatttttagcataaaaaaaaa

SEQ ID NO: 442693 - DNA, 3857 bp, Homo sapiens
ccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtggtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatgtatcctatctcacatgctattcctagaaatctggtacaatgttatcagtcataattttggttattacattaaaatgctgcatgccacagaaataaccaagtttccttgccaaccgtgtcacgaatataataaactctcatcagatcctgagccatggctatcttaagtcttcggtcattcacagttattatcttactttgattttttctgaaagctttgcaatcagctagtcccaaattgtttattcttcaaagagattcctgggaaggattctgacaggtgctctggagcacaggtttctggttcaggtcatagccttggat

SEQ ID NO: 442694 - DNA, 3678 bp, Homo sapiens
ccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcaggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtggtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatgtatcctatctcacatgctattcctagaaatctggtacaatgttatcagtcataattttggttattacattaaaatgctgcatgccacagaaataaccaagtttccttgccaaccgtgtcacgaatataataaactctcatcagatcctgagccatggctatcttaagtcttcggtcattcacagttattatcttactttgattttttctgaaagctttgcaatcagctagtcccaaattgtttattcttcaaagagattcctgggaaggattctgacaggtgctctggagcacaggtttctggttcaggtcatagccttggat

SEQ ID NO: 442695 - DNA, 2574 bp, Homo sapiens
ccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggagattcagggtcttgctatgttgcccaggctggtctcgaactcctgggctctagcaatcctcctgcctcgggactacaggcctgagctgctgcgcccagcctgggcacgaaagccgtctgtacgagagttgctggggaaatttctctgaagtctgtatcaagtggggcagcttcagcttacagggctttgggaaaagagcagttttaattttcagtgactccatgaggaatggtggaagaaaaaattggaaagagtggtttggtgagctgtaggcaaatattggaggaaactgaagttcaggacccggtccggaccacaggtgggcgacaaaacctccagacagcaaaccgggctagagtctaatagtgggggcacgagttttattttgaaacataatttttctctctacagtcaacaaatttctttttctttttttttttttgagatagagtttcgctcttattgcacaggctggagtgcaatggcttgatctcggctcacggcaacctctgcctcccgggttcaagtgattctcctgcctcagcctcccgagtagctgggattacaggcatgcgccaccacgcccagctaatttttgtactttcagtaga

SEQ ID NO: 442696 - DNA, 3877 bp, Homo sapiens
ccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtggtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatgtatcctatctcacatgctattcctagaaatctggtacaatgttatcagtcataattttggttattacattaaaatgctgcatgccacagaaataaccaagtttccttgccaaccgtgtcacgaatataataaactctcatcagatcctgagccatggctatcttaagtcttcggtcattcacagttattatcttactttgattttttctgaaagctttgcaatcagctagtcccaaattgtttattcttcaaagagattcctgggaaggattctgacaggtgctctggagcacaggtttctggttcaggtcatagccttggat

SEQ ID NO: 442697 - DNA, 2834 bp, Homo sapiens
gagtcacaggctgtgtagggttagctcccgggggacccaagcaacaagcaggggaggctgtaaagaggccgtcgggcaggggcccatggtggagacccctctattacgtgcagacccacgacctcgttagcagggtcacgcgcagacccacgacctcgttagtgagcaggggtgcaggggtggggtctggccggaggctggtcagctcccaggtgcaaagaccctgagtcctgagaactcgcccaggtggttctttggctgcatctcccgctcggaagctgtgcgtcggctgcaggccgagggcaacgccacgggcgccttcctgatcaggtgcgggacacgcaggctgtgcggcactacaagatccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtggtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatgtatcctatctcacatgctattcctagaaatctggtacaatgttatcagtcataattttggttattacattaaaatgctgcatgccacagaaataaccaagtttccttgccaaccgtgtcacgaatataataaactctcatcagatcctgagccatggctatcttaagtcttcggtcattcacagttattatcttactttgattttttctgaaagctttgcaatcagctagtcccaaattgtttattcttcaaagagattcctgggaaggattctgacaggtgctctggagcacaggtttctggttcaggtcatagccttggat

SEQ ID NO: 442698 - DNA, 1655 bp, Homo sapiens
ccatgggcgcttccaggccgcactcacggtccttgcctgccccctggcgtccgtgtggaggaaggcagtgcccgtttcttcagccgtgggtgcccctggctctgcctccccggggatcccccaaaaccctcgggccctcctcttccgggaagtcctccgggccgacccacacagctgtcgctgccctgattccactccctcttccctgcttggcccttacccgagggcgggcctgcccatgaggccgctctcaggacgcctgcccacagcagctcctgacattgggccctgtgctcaggggtggagtctggggctgggtgagggcaccgacgggtggaggggaagctgccggaagcggggagagaggcggcccccacctgtgcccccgcagctctgagggttgggaaggcagcgcctgcagccctcaccttcctgccctcaggctgcgaggcttgttcccagagggccgttggcttccctgagtgcctgagtgtccataagttggacccccaagaagccccaaccgggaggtcctcctccccctctcctgcgctcaggccggccctggcggtgcttgcccagtgggttcccatagtgcgggcgctaagtgctcagatgggccccagtgggcctgaggacttgtggggccggctgggccctcaggaggagccggggtgctctggagcgcctgtgggtgctgggtgtggctgcttcccggcctgtcatgaggaagtgggacggcccgcctgccacgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgaggtgagtgggccccgatcagggctctgtgtggccccgtgcctgccctgggccaccctcccaccccgccaacagggacctctggcctcgagccccaagcagcacccacagcgtccatgcgagagtggttccctttcaattgcacctatgtttttacctaaatacatttattata

SEQ ID NO: 442699 - DNA, 5013 bp, Homo sapiens
aacaaaaccggtatgtcaactatagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggat

SEQ ID NO: 442700 - DNA, 363 bp, Homo sapiens
ttctgtatttgaatagtattccagtaggttacatcactaaaattttgaataacagatattttcttgttttatgactgatctgaaatttcttttcagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggagg

SEQ ID NO: 442701 - DNA, 276 bp, Homo sapiens
agagtaggaagagggagggggacaggcatctaagatagactttctccatctgttgggagcctgggcaagtaggaaagaagcctttttcatacactttagttgtatggctgagctgcttggcagggcactggaaacggcgaacttgtgcagcctgcaaatgagaccactcttatttttcagttttgatttgattcactcacttgtagttaggtaaatacgggctctatgtggctcaaggaatgtcaggctggggtaggtggcaaaagatacagtgat

SEQ ID NO: 442702 - DNA, 7307 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccagctgtcttttttgtttttcaatcctttatcatacattggctttccgaatgatccctttcatcagataaagcttttctggcttagtctaggacatttgttataactttttgtaaatgataatgaaggaaagagaacagtaaacataggagttcaacaattttagaaacatccctggggtcattggactgtctgtg

SEQ ID NO: 442703 - DNA, 544 bp, Homo sapiens
ctcccagtaggttaatagtggggggtaaggcgaggttagcgaggcttgctagaagtcatcaaaaagctattagtgggagtagagtttgaagtccttgagagaggattatgatgcgactgtgagtgcgttcgtagtttgagtttgctacagccatttaggtatacctaaatggctgtaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagatacacgtgaggctttctaatgatattttcatcaa

SEQ ID NO: 442704 - DNA, 153 bp, Homo sapiens
gcggccgcctactactactactaccactgctcgaattcaagcttctaacgatgtacggggtcatgtaatttgaaaagcagtgtttcattatgaaagagctctcaagttgcttgtaaagctaatctaattaaaaagatgtataaatgttgttga

SEQ ID NO: 442705 - DNA, 7091 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442706 - DNA, 6540 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442707 - DNA, 3563 bp, Homo sapiens
gcccgaagcgtttactttgaaaaaattaggtgttcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442708 - DNA, 1274 bp, Homo sapiens
ccgaggaagatatcgtggcttgattctcttcctcccctgggcaagacaccaagtgctgggcttggatcctggagacaaggcagaagtagaggttctgtgagcttctttctttgcagcttcttcatcgtcctcctcctccacgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442709 - DNA, 4460 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaagccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaag

SEQ ID NO: 442710 - DNA, 4521 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaag

SEQ ID NO: 442711 - DNA, 4356 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaagctacccagtaactcctttgtacttgtgatgtcgatatcccggattcgctgac

SEQ ID NO: 442712 - DNA, 422 bp, Homo sapiens
  misc_feature (57)..(57): n is a, c, g, or t
  misc_feature (67)..(67): n is a, c, g, or t
caactcctccccgtctaccgccccccacgtaacccaccacggaatagaccttcttgngtgaagacgnagtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaag

SEQ ID NO: 442713 - DNA, 7037 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaacctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442714 - DNA, 3212 bp, Homo sapiens
aggcctctcagtgtaggtaggctacatttttagcaccagtttcctttatttgctttgttaatgtaatccttctgttgaaaactgttttgtaacttcctggaaaacaaaacaaaacaaaacaacaacacggaattggcgcaggagggctcgttttatcctcccaatttggccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttga

SEQ ID NO: 442715 - DNA, 2670 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442716 - DNA, 2646 bp, Homo sapiens
ggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442717 - DNA, 2856 bp, Homo sapiens
ggggacgaggaggagggggcctgttattttgcaggctcgcgggggaggccccccggccggcctgcctccgcttccccccgctgggccctccgaggccccggccggccaggcggccaccccggctgtgatttggggacgctgagggagggggcttggggtgctgggcgccggatactgttgattcgggcccgcgtagggtttcatcggacaatcaccggcgccccctgctctcccggccccggcgcccggacctgggggttcgcaaggctgcgcccgctcgttggatgacgggcgtttgggggtcctaagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442718 - DNA, 3119 bp, Homo sapiens
  misc_feature (2683)..(2683): n is a, c, g, or t
  misc_feature (2710)..(2710): n is a, c, g, or t
  misc_feature (2714)..(2714): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaacaanaaaaaaaaaaaaaaaaaaaaaaaaaanaaanaaaacaaataaataataataaaacgatatatatgaaaaaccacaaaaaaatactaacatcatattataaactctatctttaaaatgtttaatattcaaaatgtttattgctccggtcttatttaactcacaggatcataattttccaatgtcgcggtctttttaaaataaatgtcgaccttctatttaaaaaccttgtgtgtgtaaaaacctcgtgggttctactaaaatagaagacttaaggtttataaacatactctctcaccttgtggctctcacatatctataatctctcccccatctctcgcttttctcaataggtgttactccatcattttaagtccctgtgtatatattcgctggaataatattttcagacttcgtagtatttgtcgaccttttattc

SEQ ID NO: 442719 - DNA, 2512 bp, Homo sapiens
tctaaaattgattgtggtaatggctgcgcaagcttgtgaatatactaaaaacggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442720 - DNA, 2278 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcactccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442721 - DNA, 2319 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaagttgactattaaccgcgtctctgcgtttactatttccattaattggctgcgtttaacacgtttttggccttgttt

SEQ ID NO: 442722 - DNA, 2087 bp, Homo sapiens
  misc_feature (1910)..(1910): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaaaaaaaaaaggggggggggggtaaaaggatatccctgagggggggccaaaggttataccgggtacccaggttttttgtggtccaagggtgggcccatattaggggaggcgtgatattaaataaggcaagggcagttgggccgtcggttgtcacacggtcgggtgacgtgtggagaaactcggctaacgtggggactctgggggaggggaacccttcattttgggggggtggcattatgtgggacaattaccttacgggagatttaaaaggcccaggggtacactatacaacttttccacgggggttcacggggggttaaacccagcggggcatagtggctggggcgcggggagagattgggccaagggggtatgatttcggcacaactcttcttcccgacgcngtgcgacaaaaaaacgggagcaccaagacggagacaagaggcaaaaagcaaacggggcgaggagagggagagagagagacgaaagaggaagagggagaacacgagacaaagagaaaaggggagaggacgagagagcgacagaacgggaggcgagcgagacgcgatgcgagcgacaca

SEQ ID NO: 442723 - DNA, 3342 bp, Homo sapiens
  misc_feature (2025)..(2025): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442724 - DNA, 2731 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcatgcggcccccttcctgccagccccctgcccttccctgtggacggccccaggatgaactagggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442725 - DNA, 2470 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442726 - DNA, 3654 bp, Homo sapiens
  misc_feature (2337)..(2337): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442727 - DNA, 2552 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcatgcggcccccttcctgccagccccctgcccttccctgtggacggccccaggatgaactagggtgcagcccggaatcccgaggatgtggaccgggagcggcgagaacacgaacgcgaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442728 - DNA, 3466 bp, Homo sapiens
  misc_feature (2149)..(2149): n is a, c, g, or t
ccttgcctccctgccccgggcaggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442729 - DNA, 1465 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacaggtgagctgcccccctgccagtccctctgggcctcagaactgagttagagaccccccagtgggaggtcaggccgtggctctgttcttccctttccatcgacgctgcttgcctt

SEQ ID NO: 442730 - DNA, 2796 bp, Homo sapiens
  misc_feature (23)..(24): n is a, c, g, or t
  misc_feature (1479)..(1479): n is a, c, g, or t
caaactataggctagtagaggcnnggtgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442731 - DNA, 1671 bp, Homo sapiens
  misc_feature (1540)..(1540): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcaaaaaaaaaacaanaaaaaaaaaaaagggggggcaaagatcccggggcactaccgacccttgtaaaggcccagggggtaaagagcggcgcgaacggaggagtctgctggaccctggggcggaccccagaccgaaggtgcacccga

SEQ ID NO: 442732 - DNA, 2203 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttca

SEQ ID NO: 442733 - DNA, 2967 bp, Homo sapiens
  misc_feature (1650)..(1650): n is a, c, g, or t
tggcctggcagaggtgggtgggagccctgccctcgtcctcctgcctgtgggcgaggagggagtcctgcgagagaaccctcattggccatctacttaggtagcaggtttgcctccctgggcaacattcttagctacagacagggacatcttagagtcactggaatcacacaggccttccctcagcttgaggggctgcctggaggtgggggtgggggtacacctcctcagtggggagagacttgccaaatctctatcgccagcggctaagggacttgacttgaagcttgtacctccctctctctccctccccctctctccctccccaccctcaaaagacaagtgtgccatttgaccatctcgggaagtgaggagagcccccattggaccagtgtttgcttaggtgagtccatgactgctgcagatgcagccagcccagccgacctagaagctcccagggccccagaaagagaccaatgtgttgtggaggggtgggtggcagtggcagtggcagatggtaccaggcgccccagaactctaaggggcctcaagtagtttaaaacctcggaggctgcctgacttggggccaagggtttctatgctcaggcctgacccctcatggattagtttctgctggaaaaactttttctgccctcggccaggtctctatctccttctgccttaacatattttggaaggttggttcccagcagagacggggccatgggctcacactctgacctctcccacggcattagccctgtctcagcctctgggctgttacgcaagttaattcctgcacaagactcacaacagggctgtggaggaagcaaaggagccctttttatgcctctgtagtaggactgagagaggccctctggccagcgtgagcctgctggttcttcccggactgtaccaggccttgaggcggggtatggaaacgccccactctggggcctggcttggggaaggggaggcggcaggggttctttgggcttctcgagggtataatctgagctctctggggaacgtgtgtccatttgtaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442734 - DNA, 1652 bp, Homo sapiens
tggcctggcagaggtgggtgggagccctgccctcgtcctcctgcctgtgggcgaggagggagtcctgcgagagaaccctcattggccatctacttaggtagcaggtttgcctccctgggcaacattcttagctacagacagggacatcttagagtcactggaatcacacaggccttccctcagcttgaggggctgcctggaggtgggggtgggggtacacctcctcagtggggagagacttgccaaatctctatcgccagcggctaagggacttgacttgaagcttgtacctccctctctctccctccccctctctccctccccaccctcaaaagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442735 - DNA, 356 bp, Homo sapiens
gactgcatcaacgccgctgactgcatcaacgccgctgactgcatcaacgccgctgactgcatccaacgccgatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctc

SEQ ID NO: 442736 - DNA, 583 bp, Homo sapiens
tctaaaattgattgtggtaatggctgcgcaagcttgtgaatatactaaaaacggtgagtcgcacactttgagtgactcaattggagagttatctgaattacatctcaataaaggtgttgaaagaaattgcaacttataacacagtatccagtgaagcgtcccccaccccttcctccctgacccacttagccctgtacagtcatgtttctgttcagtgtttctttatgtagctagagccaaacacagatacttagttccccacctttttaaagaaaactgaaatgagagtgtggaatatacactgttctgtgctttgctttttcacttcctgtatcttggagatctttccacttgtgtgcagagagagcttcctggttctttttccattgtattctgttttatggatgggctattctttatttaatcagccccctcaggagggacatttgggttgtttccaagcttctgctgttccaaacagcctgcagccgacagccttgtccccgccttgttttgcaccgtgctaggatgtcaggtaaactcccagaagcggggttgctggtcagggctgagtagcgtcaaa

SEQ ID NO: 442737 - DNA, 374 bp, Homo sapiens
tgacctctccacggggtgggccaggcaagggggcagtaggtgccctctcatagtcattgaatgattaagtgcctgaactggaaaaactaggcccaaattaagttgagaaggccctgcctcaggcttcttctctgtaggaggaggataatagcagtgcctgtttaaaatgcgtgcagtgagcaacatccgacgtgggggcaggagggtcctggtgcattgtgaggagcatgacccagaggatgagttaggggcctgagtggacccctgtccctcacctagtctttgactctctgtgcagagcaaagccgtcgagatgacctggagagcctgggctacgtgctcatgtacttcaacctgggctccctgccctggca

SEQ ID NO: 442738 - DNA, 318 bp, Homo sapiens
ggttgggatctgaggggtcctctctgtgcccatcacagtttgagcttcagggaaaagaagaagaggtctttgcccttcgtttttccacgggaggagaatgtatgagcccaggctacctttctgggccttgtgtcgacatccctagctgtctcctcaaatctcttgccctgaatcaacctggcctgtgttctctgcggcactcggaacctggaggcggactgagcctccagcagtctaacatcttttgcagtgtcgtgaatagccgcctgttttcgcaggggcccagtgctctgcctggagaggagagagatcctggca

SEQ ID NO: 442739 - DNA, 3959 bp, Homo sapiens
  misc_feature (2685)..(2685): n is a, c, g, or t
  misc_feature (2689)..(2689): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaanaaanaaaacaaacaacaaaaaacagggcgcggcgcgcgcgctctaaaaatttctccctctcggggggcgcccaaagttttacacgcggcttcccacgaggtttcttttgtcacaagggggcgccccctatatatggagcggagtccgctattatatatatacagccatgagcgcacgtgtggcccggcggtattaaacccaaccgtttgttgcacgtgtgggaacacacagtgtgataaaccgtggtgaaacaccctgtgtgtaaaaaggaaccgcctatatactttcgtggggcggggagcccaaatactttgggcacaacaaaatctccctccatcgaagagactattttaacaagcgctctctaagggaggagaaaattaataaccaatctttaaaaggggctgatatccacagtgcgtgtttaacacactacagacgtcggaaatatttcttgcgttgagacgccgtcttaagaaaacaattgttcggggtgatccaccggagggtatattcagacctctcgactagaacacatatctttttatctaccccgcgcgggggaaccctaccggttgggtatcacaaaacacactacccgggagtgctaacgatcggttccaagagacggaggaccgcagacagacgagagaacgacgcgaccaaactaacgtagacaggccaagatgcaagagctaacacacgaacaacgaccgagaatgatccatcaacgcacgtaaataacgaagacgcaacgcagtaaacaacaggttagcatccgcagacagcgaaagtgaacgcagcgacaacagcagtccgtacagaggcagcgacagcaggaaagaggagggagagaaggagacggaggaagaagagagagggctgatgtaggagagagagggaacagcgggagaatcgagcggcaagaggaaggaagagagggacgcggagtagtgagggacaggggtggcagggaccaggagagagaggaacaaatcagaccagaggagacgagtgagcgagagcaggaaagcggggagtcaagacagaacacgggacggaacagcagcagaagagagcgaaggcgggagagcggagggagagcggagcaggcgacggcgagagagagtggggagacggaggtggagacacgacgatgaagcaagcgggaggagagcgcaagggagggtcaggacgagcgaagaggggcgacagaaggagcgaggccatgtagtcgagagggataggataggaacggatgcaggtgccgaggg

SEQ ID NO: 442740 - DNA, 3927 bp, Homo sapiens
  misc_feature (2653)..(2653): n is a, c, g, or t
  misc_feature (2657)..(2657): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggactgcctttccatggagtgggtggggaggtggtgggggccggcgtcccctgcgtgtgtgtgtgtgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaanaaanaaaacaaacaacaaaaaacagggcgcggcgcgcgcgctctaaaaatttctccctctcggggggcgcccaaagttttacacgcggcttcccacgaggtttcttttgtcacaagggggcgccccctatatatggagcggagtccgctattatatatatacagccatgagcgcacgtgtggcccggcggtattaaacccaaccgtttgttgcacgtgtgggaacacacagtgtgataaaccgtggtgaaacaccctgtgtgtaaaaaggaaccgcctatatactttcgtggggcggggagcccaaatactttgggcacaacaaaatctccctccatcgaagagactattttaacaagcgctctctaagggaggagaaaattaataaccaatctttaaaaggggctgatatccacagtgcgtgtttaacacactacagacgtcggaaatatttcttgcgttgagacgccgtcttaagaaaacaattgttcggggtgatccaccggagggtatattcagacctctcgactagaacacatatctttttatctaccccgcgcgggggaaccctaccggttgggtatcacaaaacacactacccgggagtgctaacgatcggttccaagagacggaggaccgcagacagacgagagaacgacgcgaccaaactaacgtagacaggccaagatgcaagagctaacacacgaacaacgaccgagaatgatccatcaacgcacgtaaataacgaagacgcaacgcagtaaacaacaggttagcatccgcagacagcgaaagtgaacgcagcgacaacagcagtccgtacagaggcagcgacagcaggaaagaggagggagagaaggagacggaggaagaagagagagggctgatgtaggagagagagggaacagcgggagaatcgagcggcaagaggaaggaagagagggacgcggagtagtgagggacaggggtggcagggaccaggagagagaggaacaaatcagaccagaggagacgagtgagcgagagcaggaaagcggggagtcaagacagaacacgggacggaacagcagcagaagagagcgaaggcgggagagcggagggagagcggagcaggcgacggcgagagagagtggggagacggaggtggagacacgacgatgaagcaagcgggaggagagcgcaagggagggtcaggacgagcgaagaggggcgacagaaggagcgaggccatgtagtcgagagggataggataggaacggatgcaggtgccgaggg

SEQ ID NO: 442741 - DNA, 2244 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442742 - DNA, 2159 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442743 - DNA, 3985 bp, Homo sapiens
  misc_feature (2668)..(2668): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggtgagtccatgactgctgcagatgcagccagcccagccgacctagaagctcccagggccccagaaagagaccaatgtgttgtggaggggtgggtggcagtggcagtggcagatggtaccaggcgccccagaactctaaggggcctcaagtagtttaaaacctcggaggctgcctgacttggggccaagggtttctatgctcaggcctgacccctcatggattagtttctgctggaaaaactttttctgccctcggccaggtctctatctccttctgccttaacatattttggaaggttggttcccagcagagacggggccatgggctcacactctgacctctcccacggcattagccctgtctcagcctctgggctgttacgcaagttaattcctgcacaagactcacaacagggctgtggaggaagcaaaggagccctttttatgcctctgtagtaggactgagagaggccctctggccagcgtgagcctgctggttcttcccggactgtaccaggccttgaggcggggtatggaaacgccccactctggggcctggcttggggaaggggaggcggcaggggttctttgggcttctcgagggtataatctgagctctctggggaacgtgtgtccatttgtaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442744 - DNA, 1645 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtatttcttaacacaaaaaaaaccggaggcccatgcccgggcggaaagggtcaggaacggcccggccagccggcccggccagctcctgccaagggaactgcggcccaagggcgataacccagcagacgcacagaccgagacgccccacccaacggcaccaaacacaacacggcactacacacacacacacccacaacacaacaacgcacacccgaca

SEQ ID NO: 442745 - DNA, 4330 bp, Homo sapiens
  misc_feature (3013)..(3013): n is a, c, g, or t
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacactgagacaggagaattgcttgaatctgggaggtggaggttgcagtgagccgagatcgtgccactgcactccagcctgggggacagagcgagactccatctnaaaaaaaaaaaaagtagccagagacagctgtgtacctcacctgtcttttcccttctcccttctagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442746 - DNA, 2069 bp, Homo sapiens
ggctcctggatccggctacctggcagaggctcctggccactgttcgcaggtcttcccttgctctgaaagcagcagaggctctgctcacgggcaggctaggctttcatcacggtaggatagggaaggccatggctctgttgcctccttttcttgcctctcacagattggaagtatctagggacagtgggtggctaggacagtgctggctgcagggggtctgggagcgtgggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaa

SEQ ID NO: 442747 - DNA, 3599 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctc

SEQ ID NO: 442748 - DNA, 1527 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttca

SEQ ID NO: 442749 - DNA, 1952 bp, Homo sapiens
tgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttca

SEQ ID NO: 442750 - DNA, 796 bp, Homo sapiens
  misc_feature (777)..(777): n is a, c, g, or t
ggggacgaggaggagggggcctgttattttgcaggctcgcgggggaggccccccggccggcctgcctccgcttccccccgctgggccctccgaggccccggccggccaggcggccaccccggctgtgatttggggacgctgagggagggggcttggggtgctgggcgccggatactgttgattcgggcccgcgtagggtttcatcggacaatcaccggcgccccctgctctcccggccccggcgcccggacctgggggttcgcaaggctgcgcccgctcgttggatgacgggcgtttgggggtcctaagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccaccccaagaacttcctgcagacggtgcggaagatcctgtcgcggctgttccgcgtgttcgtgcacgtctacatccaccactttgaccgcatcgcgcanatgggctccgaggcccacg

SEQ ID NO: 442751 - DNA, 308 bp, Homo sapiens
cttatctgtaacattttgttttattttattattttattttattttattttctcacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 442752 - DNA, 2199 bp, Homo sapiens
gttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagtggaaagcagcagtaaattaaactagaaggatatattttatacctagaaataaataaagctcaacttgttttgtaagcctgttttaaaaatatttaatcatttaatttgtgcaagtatagagttctcctatggcaaaactataccatcatcttctccaattgtgcatggcagctgtactaagttctgcaaaaacaagacatatggatgtgtttcataccttctcagaattggtatatcaagacacatttaaatataagccctctggaaatggatttatatacagtcaacataaatacccccttagaaattggtaatattttatagccaggtttaggtttagtgtcaagtatagtgattgctggtctatcactactcatgaagtggaaccccctctactcataaaaaccccaatcaaacatatagatgaatagaaccttgataacattagaatgccttgttctctgaaggcttagaagacaatacgtcaggaaatatgaaggagaagctgaggaacgaaagaaacttcgacaagagaatggaaatgtacatgctatagcataactgaagataaaattacaggtttgagttttaaaatatatctttagatcatatcctataattttgaaaaatttaacactatataatctcaagaaaaatatggaatgtgttcttaattatatatacactatgaacaatggctatgttaaagtattattctttgagtataagatggaattcaatgttgagaatagactacgtgtttaataagtattattagggatataaatataagagacactggtccagttctcaaagaagttattgtttagtagataggaaaaaaaatgtaagaaaccagaatactagggatgtaaaataaatgtcatgagaaaggaaccaatggagtatgagaagtttccagtgaaaaacagaaagaatccagtagaatttatttagggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggcacagtggctcaggcctgtaatcccagcactttgggaggctgaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaa

SEQ ID NO: 442753 - DNA, 1546 bp, Homo sapiens
  misc_feature (1)..(3): n is a, c, g, or t
  misc_feature (1363)..(1363): n is a, c, g, or t
nnngagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaattacaaaaacttaataatataaaattattgattatattcaattttatattgatatccctttatattttaccctatttcccttcaatctttttcccttacccttttttttaccaacnatcttatacttctaaacatctttacttacccttttctaatatctttttataatcattccactttttttcctcttttatcttatatttctattgcctctttcttattttattttccttacaacttcctcacttttaaaatataatagtctcttcttttcgtctttttttccttttcccctactt

SEQ ID NO: 442754 - DNA, 1071 bp, Homo sapiens
gaaaatgagctccatggaaattatcaatttgattataatctgttgtaatctgggtgttggagcattgtaacatagagtaactctaatttataattctcagttttttccacctgcaagtagtactcactaattcccaactataatcatgagtggacactactttcaggtagaaaaaactgaaaattataaattagggttatgcagtcctctctaacttttatattgtgttaggtaatgaggcacgcatggctgttacccctgtgagcgctcactgctatgacatctttctctcatgtctctaaaattatattcaagtttgagagactcttgtcaataaatcttttcttttttagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 442755 - DNA, 722 bp, Homo sapiens
tgccatctgggactatggctaggctggctggaactagttgaagatttgaggtaagaacaattaaccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 442756 - DNA, 2147 bp, Homo sapiens
gttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagtggaaagcagcagtaaattaaactagaaggatatattttatacctagaaataaataaagctcaacttgttttgtaagcctgttttaaaaatatttaatcatttaatttgtgcaagtatagagttctcctatggcaaaaaaacaagacatatggatgtgtttcataccttctcagaattggtatatcaagacacatttaaatataagccctctggaaatggatttatatacagtcaacataaatacccccttagaaattggtaatattttatagccaggtttaggtttagtgtcaagtatagtgattgctggtctatcactactcatgaagtggaaccccctctactcataaaaaccccaatcaaacatatagatgaatagaaccttgataacattagaatgccttgttctctgaaggcttagaagacaatacgtcaggaaatatgaaggagaagctgaggaacgaaagaaacttcgacaagagaatggaaatgtacatgctatagcataactgaagataaaattacaggtttgagttttaaaatatatctttagatcatatcctataattttgaaaaatttaacactatataatctcaagaaaaatatggaatgtgttcttaattatatatacactatgaacaatggctatgttaaagtattattctttgagtataagatggaattcaatgttgagaatagactacgtgtttaataagtattattagggatataaatataagagacactggtccagttctcaaagaagttattgtttagtagataggaaaaaaaatgtaagaaaccagaatactagggatgtaaaataaatgtcatgagaaaggaaccaatggagtatgagaagtttccagtgaaaaacagaaagaatccagtagaatttatttagggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggcacagtggctcaggcctgtaatcccagcactttgggaggctgaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaa

SEQ ID NO: 442757 - DNA, 2146 bp, Homo sapiens
gttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagtggaaagcagcagtaaattaaactagaaggatatattttatacctagaaataaataaagctcaacttgttttgtaagcctgttttaaaaatatttaatcatttaatttgtgcaagtatagagttctcctatggcaaaactataccatcatcttctccaattgtgcatggcagctgtactaagttctgcaaacatttaaatataagccctctggaaatggatttatatacagtcaacataaatacccccttagaaattggtaatattttatagccaggtttaggtttagtgtcaagtatagtgattgctggtctatcactactcatgaagtggaaccccctctactcataaaaaccccaatcaaacatatagatgaatagaaccttgataacattagaatgccttgttctctgaaggcttagaagacaatacgtcaggaaatatgaaggagaagctgaggaacgaaagaaacttcgacaagagaatggaaatgtacatgctatagcataactgaagataaaattacaggtttgagttttaaaatatatctttagatcatatcctataattttgaaaaatttaacactatataatctcaagaaaaatatggaatgtgttcttaattatatatacactatgaacaatggctatgttaaagtattattctttgagtataagatggaattcaatgttgagaatagactacgtgtttaataagtattattagggatataaatataagagacactggtccagttctcaaagaagttattgtttagtagataggaaaaaaaatgtaagaaaccagaatactagggatgtaaaataaatgtcatgagaaaggaaccaatggagtatgagaagtttccagtgaaaaacagaaagaatccagtagaatttatttagggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggcacagtggctcaggcctgtaatcccagcactttgggaggctgaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaa

SEQ ID NO: 442758 - DNA, 2144 bp, Homo sapiens
gttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaaagggggtttttatacaacaacaagaagtttttaaataattgagtttttaaagtggaaagcagcagtaaattaaactagaaggatatattttatacctagaaataaataaagctcaacttgttttgtaagcctgttttaaaaatatttaatcatttaatttgtgcaagtatagagttctcctatggcaaaactataccatcatcttctccaattgtgcatggcagctgtactaagttctgcaaaaacaagacatatggatgtgtttcataccttctcagaattggtatatcaagacacatttaaatataagccctctggaaatggatttatatacagtcaacataaatacccccttagaaattggtaatattttatagccaggtttaggtttagtgtcaagtatagtgattgctggtctatcactactcatgaagtggaaccccctctactcataaaaaccccaatcaaacatatagatgaatagaaccttgataacattagaatgccttgttctctgaaggcttagaagacaatacgtcaggaaatatgaaggagaagctgaggaacgaaagaaacttcgacaagagaatggaaatgtacatgctatagcataactgaagataaaattacaggtttgagttttaaaatatatctttagatcatatcctataattttgaaaaatttaacactatataatctcaagaaaaatatggaatgtgttcttaattatatatacactatgaacaatggctatgttaaagtattattctttgagtataagatggaattcaatgttgagaatagactacgtgtttaataagtattattagggatataaatataagagacactggtccagttctcaaagaagttattgtttagtagataggaaaaaaaatgtaagaaaccagaatactagggatgtaaaataaatgtcatgagaaaggaaccaatggagtatgagaagtttccagtgaaaaacagaaagaatccagtagaatttatttagggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggcacagtggctcaggcctgtaatcccagcactttgggaggctgaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaa

SEQ ID NO: 442759 - DNA, 1242 bp, Homo sapiens
  misc_feature (1)..(3): n is a, c, g, or t
nnngagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacaga

SEQ ID NO: 442760 - DNA, 786 bp, Homo sapiens
  misc_feature (1)..(3): n is a, c, g, or t
nnngagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcagaatatttcgtgacggtgttgggatacatcgggatcctctagatcacctcc

SEQ ID NO: 442761 - DNA, 686 bp, Homo sapiens
tgcgcgagcttggagccgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattg

SEQ ID NO: 442762 - DNA, 643 bp, Homo sapiens
tgcgcgagcttggagccgggtagagggcgggccttccgggacgagggcgcgtgggtgaggaaggtcaggtctagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattg

SEQ ID NO: 442763 - DNA, 830 bp, Homo sapiens
  misc_feature (724)..(724): n is a, c, g, or t
  misc_feature (738)..(738): n is a, c, g, or t
tgcgcgagcttggagccgggtagagggcgggccttccgggacgagggcgcgtgggtgaggaaggtcaggtctaggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgaaaaaaaaaaaaaaaaaaaaaaatgtggggggggggcntgaaagtttaaacntggtggggggggcaggatggaagggaagggtcaggaaccggcgaaaggggtttccaaaaaggggcggcgttggcacccagggtggtcggtag

SEQ ID NO: 442764 - DNA, 976 bp, Homo sapiens
aattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacaggtgatgacaaacacaaagagggacctatgagagactttttttcagtagatcagaaaaggaaaaaaattagcctttctatccttgtagttttgttcttataatagagcccaggtagttcaaaaggtacagttggcaggagaaagtcttctttcaaaatacccataatggagagaccaaaaaaaaaaaggaaattcatgcttgttggaagatatattttaattatgtctacaacatgactaatgttgaatagatactgagctgtagagaggtgtttaatcatttgttaatctaagagcactctaaaaaggatgccaagaggccaggcgcagtggctcacgcttgtaatcccagcactttgggaggccgaggcaggcagatcacgaggtcaagaaatcaagaccatcctggccaacttggtgaaactctgtctctactaaaaatacaaaaattagctgggcatggtggtgcacgcctgtagtcccagctactcgggaggctaaggcaggagaattgcttgaatctgggaggcggaggttgcagtgagccgagatcgcgccactgcactccagcctggcaacagagtgagactccatctcgagaaaaaaaa

SEQ ID NO: 442765 - DNA, 739 bp, Homo sapiens
aattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattg

SEQ ID NO: 442766 - DNA, 883 bp, Homo sapiens
  misc_feature (777)..(777): n is a, c, g, or t
  misc_feature (791)..(791): n is a, c, g, or t
aattactctcttccatattggttaacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgaaaaaaaaaaaaaaaaaaaaaaatgtggggggggggcntgaaagtttaaacntggtggggggggcaggatggaagggaagggtcaggaaccggcgaaaggggtttccaaaaaggggcggcgttggcacccagggtggtcggtag

SEQ ID NO: 442767 - DNA, 2016 bp, Homo sapiens
cggggagacggttgtcgggctggttcctgtgctggatcctgggcggcctgaggggtacggagactctgggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacattttt

SEQ ID NO: 442768 - DNA, 2086 bp, Homo sapiens
cggggagacggttgtcgggctggttcctgtgctggatcctgggcggcctgaggggtacggagactctgggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaaatgggaggttcccttcccttccacagtgcaaggaagacgccgaggagtggacctaccctatgagacgagagatgcaggaaattttacctggattgttcttaggcccatattcatctgctatgaaaagcaagctacctgtactacagaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacattttt

SEQ ID NO: 442769 - DNA, 1266 bp, Homo sapiens
cggggagacggttgtcgggctggttcctgtgctggatcctgggcggcctgaggggtacggagactctgggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagctacttgggaggctgaggcaggagaattgcttgaactcgggaggcggaggttgcagtgagctattactccagcctgggcaacaagagcgaaactctgtctcaaaaaaaaaaagggggggggggacattaagagagtggtgatgacccaaatgttgaaccaatttatgtttagggtgggtgggtgttcttagctgttgaatcctgaatgggtttatcaaacgtgaactagctggcttaatgcagccagcgttctggggcagcagaacattttcattcttactggtaaattctattggctggcttccaaaggtgatgattttcaagcagacatgttctatatgggtctggggtttaaggatctgggtgcccagcctctatcagagcttgcctaccgggcaaagctgcctacccttcaagtggggaaaatttaatccactggtttaacaagggctcaccctctccaccctgtcctaacgacctttggtggaatgtgctgggatatttgctggctcaatagcaagggggtagctctgcttacattttaagaaagtggaggctgagggcatggtatcaatactggtgtgcaactccaagaagttttcctggttaaaatttaaaggaaagatctgtggtatggattaaccattttcttatgcctgggtatggacattttcagtggtctttctacgtctaggggtgaaatgtg

SEQ ID NO: 442770 - DNA, 1259 bp, Homo sapiens
  misc_feature (1230)..(1230): n is a, c, g, or t
cggggagacggttgtcgggctggttcctgtgctggatcctgggcggcctgaggggtacggagactctgggggagggagacggcagcggcatggcggccgggtgtaagacgcccgaccctcctcttccctgtcttcgccgccgccgctgctggagtcactgggaccctctagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaaacaccgatgcggccactctctttttntcttacatccggatgaaaacgatcataga

SEQ ID NO: 442771 - DNA, 3457 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442772 - DNA, 2378 bp, Homo sapiens
aaaaactgatgaaggaaattgaagaagacacaaataaatggaaaggtatcctatgttcatggattggaaggattaatattattaaaatgttcatgctgcccaaagcactatatagattcagtgcattccctccaaaatttttaaatttaatgacatttttcacgaaagcagaaaaaataatttttaaatatacatatttcagaatacattgttcacaataaagatatatgattttttgtcagttaaaagttaatttttttaaaaagatacctatagcctcttattgaggtggaatctgttgctcttggagctacgtactgttgactttggttttctggaaacatcagtgctatttagaacattaggatatttttctttttgaatatcaacaaaaacataaataaaaatactagtaatgacatttacagtatgtttcacagattaatcacatctctgagtgggagtctttatctgttgtaggatctactcttgccattctattctgggttttggttgattagtctttcttgaacacttccagaaattggagatgtatgcctgccttaggtagcctagcttattttattaatgaacatatccatttaaaaatttcttcctggtaatgagtctaaacttgccttcctgtaatttgtatccactggtcctttttctttgttctccctcttgcatatgccagtacttcaatagctggtcccagctccattgacgccctctctcaggatcacacatcacaggtccttcagaatctcctaatggtctctctgatctccaggcaacacactactctaacctttctatgcttttctggcctgcagttcatttctgttcctgtgaagtcatagagcccgcaattcatgctgtcttgttcccctattaaaatatatttttgtaaatctctttaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggttggtatgacttggccctgttcagggatatcttaatctttgacaggggttcaatatgtaagttcatttgctggtgggttaactacattgtagaaactattttatgggtggcagtcttgttaaccatgaccttgtactcatgtctgaaaatctaataattattacggaaaacctttttttttttttttttgacttttcactggtttaggttttcattggtttaggtttctaccaatcgatttcaaccaaacattgtttcctgtttcccctctatgatgtcttctttgactagatttcatggtacaaagaccacgggctagagtcagaaaggtctggattcatgtccttgggttttctattctttttttttttttttttttttttaagagattgagagtgtctctctgttacccaggctggccccgaactcccgggctcaagcaatcctcctgcctcatcctcttgattggctgggtctacaggtccacaccattgtatccagccctgactttgctttttgaacttcatttactcacttcacttttctaggcctcattttcttcatttataaaaatggcataacaactgcttctcagggttgttgtgaatatttatgaaatttagagaaaggaaaataaaagtttgttataagatttcatgttaagagatacttttggcatgttaagagatacaatggttcatgcctgtaatccagcactttgggaggctaaggtgggtgggttgcctgagctcaggagttcaagaccaggctgggcaacatggcaaaatcctatctctactcaagaatacaaaaattaaccaggcatggtactgcacaactgtagtcccagctacttgagaagctgaggaaggagaatctcttgaacctggcaggtggaggttgcagtgagctgagatcatgccactacactccagcctgggtgacagagtgaaattctatctcaaaaaaaaaaaaaaaaaagaggccaggtatggtggctcatgcctgtaatcccagcattttgggaggccaaagcaggtggatcacttgaggtcaggagctcgagaccagcctggccaacatggtgaaaccctgtctctactaaaagtacaaaaatcagccaagcgtggtggtgcatgcctgcagtcccagctactcgggaggctgaggcaggagaatggcatgaacacaggaggtaaaggttgcagtgagccgagatcacaccactgcactccagcctgggcgacagtgcgagactctgt

SEQ ID NO: 442773 - DNA, 686 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggtgagtctactagaatcattgacttaaatgtgcagagacatcggtgtcccaaaagataaagaaaggccttctgaattgagaggtgaaggtttagaatggatgatttgcgtaatggaatttacaacttcatatggattgtgtaaaataaatggttgtcaagta

SEQ ID NO: 442774 - DNA, 3536 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagtaaacacctgttgactgcctattatgttcttgggattggggaaggtgctagacattggcctaagtgccaagtgcatctca

SEQ ID NO: 442775 - DNA, 3312 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442776 - DNA, 3474 bp, Homo sapiens
aaaaactgatgaaggaaattgaagaagacacaaataaatggaaaggtatcctatgttcatggattggaaggattaatattattaaaatgttcatgctgcccaaagcactatatagattcagtgcattccctccaaaatttttaaatttaatgacatttttcacgaaagcagaaaaaataatttttaaatatacatatttcagaatacattgttcacaataaagatatatgattttttgtcagttaaaagttaatttttttaaaaagatacctatagcctcttattgaggtggaatctgttgctcttggagctacgtactgttgactttggttttctggaaacatcagtgctatttagaacattaggatatttttctttttgaatatcaacaaaaacataaataaaaatactagtaatgacatttacagtatgtttcacagattaatcacatctctgagtgggagtctttatctgttgtaggatctactcttgccattctattctgggttttggttgattagtctttcttgaacacttccagaaattggagatgtatgcctgccttaggtagcctagcttattttattaatgaacatatccatttaaaaatttcttcctggtaatgagtctaaacttgccttcctgtaatttgtatccactggtcctttttctttgttctccctcttgcatatgccagtacttcaatagctggtcccagctccattgacgccctctctcaggatcacacatcacaggtccttcagaatctcctaatggtctctctgatctccaggcaacacactactctaacctttctatgcttttctggcctgcagttcatttctgttcctgtgaagtcatagagcccgcaattcatgctgtcttgttcccctattaaaatatatttttgtaaatctctttaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442777 - DNA, 1633 bp, Homo sapiens
cccctgtcttataatacaatctatacactaaggataagaaatctgtgtctgtgatataagttaccaataattttcctcagatgtcatcttttgcttgtttttcataagaacttattcttagccaggcatggtggctcacgcctgtaatcccagcactttgggaggccaaggcaggtggatcacctgaggtcaggagttcgagaccagcctggccaaaatggtgaaaccccatctctactaaaaatacaaaaattagctgggcgtggtggcaggcacctgtaatcccagctatcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442778 - DNA, 1160 bp, Homo sapiens
aactagttccatacctactcagtttttcaaagaatatatccaagactttgaaagtggaatcagaaatggaaaaaggaccaaaaagaaaaaaaagatagtgaagagaatccagaaataatttggtggcaggtttttatattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442779 - DNA, 1759 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggttggtatgacttggccctgttcagggatatcttaatctttgacaggggttcaatatgtaagttcatttgctggtgggttaactacattgtagaaactattttatgggtggcagtcttgttaaccatgaccttgtactcatgtctgaaaatctaataattattacggaaaacctttttttttttttttttgacttttcactggtttaggttttcattggtttaggtttctaccaatcgatttcaaccaaacattgtttcctgtttcccctctatgatgtcttctttgactagatttcatggtacaaagaccacgggctagagtcagaaaggtctggattcatgtccttgggttttctattctttttttttttttttttttttttaagagattgagagtgtctctctgttacccaggctggccccgaactcccgggctcaagcaatcctcctgcctcatcctcttgattggctgggtctacaggtccacaccattgtatccagccctgactttgctttttgaacttcatttactcacttcacttttctaggcctcattttcttcatttataaaaatggcataacaactgcttctcagggttgttgtgaatatttatgaaatttagagaaaggaactgaggatcctgtagagtcacctcagca

SEQ ID NO: 442780 - DNA, 966 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagagccacctgtatagaaatggtgacatcactggcatatactcatcatgggcgacaatatcttgctcaagaaggagtaattgaccaaatttctaatataattgttggggcagattcagaccctttctctagcttctatctgccaggtaaggaacactgatgcctatggaaatgatggtgcgtgttttatttctgagttatctctgacatcagggggttggggtagggagtggacagggattgttttcctttagagctgatttccttaatgagctgatttcgtttagaagatatctagagcaaccaagttcaaatt

SEQ ID NO: 442781 - DNA, 364 bp, Homo sapiens
gagtgaaagctgctgtttcaaaaagaagtctgtgtggaggagacgctgacgcaagcttcagctattattaggttgttacttcctacctgggcaggatatgaactaataagatttatgatgtctccttcagggaaaagactactttgtgtgtatccattctggagagattgctccaagctatggaaccggttcacgtggcccggaacctcagggttgacctgcagaggggactaattcaccctgatgattctgtaaaaatcctcactctttcccaggtatgaaattctactaggaaccgacattgaccacctgctctgggccaggttctgcactgggacagaaagatgaagaaagcacagtattt

SEQ ID NO: 442782 - DNA, 336 bp, Homo sapiens
ggaattattgtttgatggatacagagtttcagtttgggttgatgaaaaagttctagagatggatggttatgatggttgcccaacagtgtgaatgtacttaatagcactgaactatacactaaaaatggttaaaatggtaaattttatgttgtgtatattttaccataataaagaagaatctcactgttatccttcaaaggaactcgctttgaacgcttgcttatgagaataggacatcaatcaaagaatgccccagtggagctaaaaattagatgtttggatgcaatttcatctcttctgtacttaccagtaagtaggtagggaaataatgaagga

SEQ ID NO: 442783 - DNA, 1194 bp, Homo sapiens
  misc_feature (974)..(974): n is a, c, g, or t
  misc_feature (1084)..(1084): n is a, c, g, or t
  misc_feature (1090)..(1090): n is a, c, g, or t
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccagaatcgtgaagttttttgaaccttgctgcattgtaagtcttacagatctggagcgtaatctatctttgnggaaaagtcttggaatgattgaagtatgacccactttattgtgtgacttagaccaactgggatcttgaatccatgttacggaaccggttttcacgaaacaggactactcnaaactntcgtttagaattggacttaattaagaatgcccacggggctaacttttgagagaacaaactcgcttttcttatattggaccatgagctctccggcatatagtact

SEQ ID NO: 442784 - DNA, 3404 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaacctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagt

SEQ ID NO: 442785 - DNA, 3451 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcatactgaaaaaaaaaaaaaagaaaaaatggtgcggcgcccgagcctcagaaaaatgtcttttagacatcgtttgggcgcgggcccatgagtaatgtacattggccaacgctgtccaaggagccctggctgcatggggggtcccccataaaacgcgggggcaccgggtctgacatccagggtcggggctccgcgctcaccgggcacgcgaccccccccgccctgatgagaaaaagacgaagaagaaaaaaagcaggagaaaagagaggcacaaaaaaaacataaaacacacaaaaagag

SEQ ID NO: 442786 - DNA, 1642 bp, Homo sapiens
agggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccatagggaaaagactactttgtgtgtatccattctggagagattgctccaagctatggaaccggttcacgtggcccggaacctcagggttgacctgcagaggggactaattcaccctgatgattctgtaaaaatcctcactctttcccagattggaagaattgttgaaaattctgatgctgttactgagattctaaataatgctgaattactaaaacaaattgtttattgcattggtggagagaatctatctgtagcaaaagcggctatcaaatccctgtcaagaatatcactaacccaagctggactggaggctttatttgaaagcaatctgctggatgatttgaaaagtgtaatgaaaacaaatgacattgttcgatacagggtgtatgagctaattatagagatttcttccgtgtcaccagaatctttaaactactgtaccacaagtggattggtaacccagctcctgagagagctgactggtgaggatgtgttggtcagagccacctgtatagaaatggtgacatcactggcatatactcatcatgggcgacaatatcttgctcaagaaggagtaattgaccaaatttctaatataattgttggggcagattcagaccctttctctagcttctatctgccaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggaactcgctttgaacgcttgcttatgagaataggacatcaatcaaagaatgccccagtggagctaaaaattagatgtttggatgcaatttcatctcttctgtacttaccacctgagcagcagactgatgaccttctgaggatgacagaatcctggttttcttctttatctcgggatccactggagctcttccgtggcattagtagtcagcccttccctgaactacactgtgctgccttaaaagtgtttacgggaaggaaacacctgcatcttgaagaactagtaggaggcaatcaagtgaagaatacagtggagtagcaaagcaagacagcaggtacacatgaaaacaagagaacatgtttgagaaactacaagtaattcaatatgaccaacgcctaggatttaaagggaaatttttgcaaaattctttatcattattactaataatagctaccatttcttagcattgattttatgttaggcacttggcatgcatttcttactttatcatcataatagccataaaagttacgtatcatttcaca

SEQ ID NO: 442787 - DNA, 251 bp, Homo sapiens
atgatattattactcaacgactatcgcttttaatatagttgttggggccttaatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtca

SEQ ID NO: 442788 - DNA, 528 bp, Homo sapiens
gccatggagtacacagggagcaaatatatcggggaatatgtagatgggaggatggagggcaaagcaagtacatcctccctaccgaaacaatatatgttggggaaatgaaggatggcatgtttcacggcgagggaaccctgtacttccccagcggaagccaatacgacgccatttgggaaaacggattggccataaaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtca

SEQ ID NO: 442789 - DNA, 624 bp, Homo sapiens
tgtgagaggtctgaacagtgatgtccagttcaaggatggagggcaaagcaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtca

SEQ ID NO: 442790 - DNA, 640 bp, Homo sapiens
gccatggagtacacagggagcaaatatatcggggaatatgtagatgggaggatggagggcaaagcaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcagatgatgacgagcatgagtggatcacccgtacctgtcgaaagggctaggatgagatcgtgggtcacaggcccgagccgtgaactctgtggctgcctccaccagaggtttccatctgccctactagcattggctgccctgggggacgggctgtagttctagaacctgattttaactcaggaataaagactttctgcggtca

SEQ ID NO: 442791 - DNA, 556 bp, Homo sapiens
tgtgagaggtctgaacagtgatgtccagttcaaggatggagggcaaagcaagtacatcctccctaccgaaacaatatatgttggggaaatgaaggatggcatgtttcacggcgagggaaccctgtacttccccagcggaagccaatacgacgccatttgggaaaacggattggccataaagggcacatatacgttctcagatgggctgcactatgatgagaaaaactggcattactgcgacggctatgatcggaggttttacacagagatcctcaatggcttgaagcctgcaggtatggctcaactcaccaatatggacccacctagaaaaatccccaagggctattacgattgtggagacggcttctataacccagtcacgagggtagtcaaggactataggaaccgctttctaagaaacgcaggtaggtttcttccgacactgcagcacgttttctcttcacccacatatgagtatgtgcatctgtatgtacaaatgtatgcacacacttgatgagaaagaagcttttgctgatagaagatgaaagttgattac

SEQ ID NO: 442792 - DNA, 807 bp, Homo sapiens
attagattcactttggtctgcagtcctgcgtctcctggttagccttgtcgagtattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442793 - DNA, 2786 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatatatatgtatacatatatacacatatatgtatacatatatacacatatatgtatacatatatacacacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442794 - DNA, 664 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagttctttttttttctcctagtactgtgaatatatgcctgatgttgctaaatgtagacaatggttagagaagaattttccaaatgaatttgcaaaacttactgtaggtatgaacattttttttcttgcattaaacttctgtacctgagacaaatgcatgtatggcattattctaaagataggaaagtcctcctttagtaggatattacagaattaacatttatctgttagctgtttaagttctctctgagataggataggtctgaatatcaactttcttacataaaaaagtaaatgggccgggcgcagtggctcacacctataatcctagcagtttgggaggctgaggcaggcggatcacaaggtcaggagatcaagatcatcttggctaacacagtgaaaccccatctctactaaaaatg

SEQ ID NO: 442795 - DNA, 2720 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442796 - DNA, 2600 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442797 - DNA, 2376 bp, Homo sapiens
atcaatatcctgtataccggagatgttgaaagtaaggtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442798 - DNA, 2580 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442799 - DNA, 1595 bp, Homo sapiens
tctagagatcacgtgtttcctttgtctgcttattactgtctactactatgtcttgcttatttaatctagtcttcctttctagaatgtaattaaccacaagagtacgacatcttttattgtcttatcctcagcaatctgcaacagtgtgtagcatatagtacacttccaataaaaatcaatatttatttgcccctaaatcatttactttatttaattttgtttttttgagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442800 - DNA, 1152 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactg

SEQ ID NO: 442801 - DNA, 2766 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatatatatgtatacatatatacacatatatgtatacatatatacacatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgta

SEQ ID NO: 442802 - DNA, 2801 bp, Homo sapiens
attgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatacatatatacatacacatatatgtatacatatatacacatatatgtatacatatatacacatatatgtatatatatgtatacatatatacacatatatgtatacatatatacacatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgcaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaaccagtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgtaaaaaaaaaaaacgacgagagaacaagacaaagcac

SEQ ID NO: 442803 - DNA, 5679 bp, Homo sapiens
  misc_feature (36)..(36): n is a, c, g, or t
  misc_feature (180)..(180): n is a, c, g, or t
  misc_feature (501)..(501): n is a, c, g, or t
  misc_feature (5381)..(5381): n is a, c, g, or t
atttgattccattctgacactgtctatctggatatngggtcagctcccataggctgagggctcaatcccacaacagcgcacacacattaatgccagtcacaaacacaagttgtggcctgtgcttctcaatgaccagctgtgaattgtgaattctgatgaccccctccttgaaattgattngtttgcttgagtggctcacataacacagggaaacacttatatttacccatttattatagaagatgctacaaagcacacagatgaacatctagatggaagtgatctattagttgagatatgggaaaggagtgaggagctgggatgtattctctcatgtattctgtcttttttgagttttcatggaggccccattatggaggccttgcttccattattggcattggtgatcaactgaactttcattccctctgtcctcccgagaggacagaggcttagtctaaccgagcctcagcctttccagtgaccacccaccgagccttngttccggtgaccgccctccatcctgaagctacctaggtgctccagacaccaattatcccattaatgtacaaaaagatacttatcactccactgatttcaagtgagctcttatgtcaggagagggggatgaagaccaaatctgtatgtcacattgtcacaatctggatctgtcagctcacccacttcaatttaacctattctcacatttttctcctcttctccttttatgtgaaattttgaactctccccttagccacttggtgaaatgtgtttttcattttaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaatcacattctttctgccaacatagttttatcctgtctcagtaggatactccataacacaatagcagtacaccactaggctcttaaacgatcaagaacaatttttttcatggtgaaatcaaataacgcagttttggaaacctataaccgcattttgtgcttgaattacgtgccccacactgtggcttaggatacttattggggtataatgaaaatcttactgaaagttaatttcacattcttacaccccaaaatctgcattgccattgatgcatatgcaccacattattatatttccacatcagtttcttgtgtgccaaataagacccatgctatgcatcttggtttccatgaagtgaaaatacatagtaagaatgcgagaaatataaatcaggccaggcacggtggctcacacctgtaatcccagtactttgggaggccaaggcaagcagatcacctgaagtcaggagagaccagcctggccagcatagtgaaaccccatctctactaaaaatacaaacttagctgggcttagtggtgcatgcctgtagtctcagctacttgggaggctgaggcaggagaattgcttgaatccaagaggcagaggttctattaatggagatcattccattacactccagcctgggcaccaggaacgaaactcgttctcaaaaaacaaaacaaaanaaaaaaaacgttggctgggcatggtggctcacgcctgtaatcccaacaatttgggaggctgaggcaggtggattacttaaggtcaggagttcaagaccagactggccaacatggtgaaaccctgtctctactaaaaatgcaaaaacattagctgggtgtggtggtgcatgcctgtaaatcccagctacttgggaggctgaggcaggagaatggcttgaacccaggtggtggaggctgcagtgagctgagatcacgccatcgcactccagcctgggcaacaagagcaaaactccatctc

SEQ ID NO: 442804 - DNA, 1720 bp, Homo sapiens
  misc_feature (2)..(2): n is a, c, g, or t
  misc_feature (4)..(4): n is a, c, g, or t
  misc_feature (893)..(893): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtaaagtgatactcctggtggattgttcttttatttcttcctgaaatgcctggcattggcattgcgaatcttctctgagtctgaagcgtcctgcctgacatgtttgctagcactcacccgcgccttccctcagtccctctcatctcgtttagattccatctcccgtgatccagtgacatgaacttgggaagaggctgcactgggcatggtcctgggaagggctcacacccagacatggatggagacggggtgagggtcctgtggtgtcagtgctgttgggcagcagggattgctcaggggccgcatctggatgcactgtcagcgctgtgtaaaccatgataacagaagctgcccatgaagtcaggtgcacacgtacctgctcactggcatagaaaagaacactaaggggaaagctttcctgcctcattggtaactgcatttgaagccgaacaagtgagtcattggntttccgactccaaactcgtaaagactgggaacagaatggaaagtttagacactgacattggagatagatgattctttcattccatcatccattttaatgtatgacgtcaacataaatgtgtaacaagattcattaaactagtctcagaagctctatcccatggagactgtgatgttcttacaagaacctttgtccgtcgggtattgtaggtgagaatggcatataagcagaacaaccttgccattagagagaatggaactgtatttttgttttaccagttatgagtcaacattttgtttcttttattttgaacatggcatcatgtatatatttcttttatagtgaaatgatacatttatgtgccaagaggtaaagcatcccttttcctgtccagccttccacccttcctcacatcttagtggggagccactgttctcaattctgtgggaagggtcagtgcaagtcctgtagaaatgtattttgacatcattatgagatttaaacaaattcctcagtgaatgtttggttgtgatatgttaacctgcaagttttgaacattgacatgttttcgtgttaggaaacaggagctcacttttctacatccttgttggagcatgctgggaatgaagacaggtggatcttttaactttctcacttctataaagaatgccacacagggtgctgcatggtggctcacacctgtaatcccagcacttgtggaagccaaggtgggaggatcatttgagccccagagattgaggctgcagtgagccatgatagtgccactgcacttcagcctgagtgatagaacaagaccttgtctcaaa

SEQ ID NO: 442805 - DNA, 853 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggtaggtctctcctccaaagctctggaaacagactcctgggagtgagagggaggggagcgcaggcaccgccccctttccccaagtcccccgcccacttcatccctcaggcacctcccaactcctggcctctctgcacgaggcgcctgccccgggccccgcctacaggggacccagctcttcttgcagccactggaagctgatcacctggagtgaagacctcacacgtgagtttccctctgtttaggttaaacttgggcttcccaggctcctgcacatccagactcgatttgcaggagtcctcagagacatatgtgtatatatgagtgattgtagttcactgcagcctggacctcctgggctcaagcgatcctcccacctcagcctcctgagtagctgggaccaccggtgtgtaccaccaccacgtttaaataattttttttatatatatttagtagagaggaagtctcactgtgttgcctgagctggtctcgaatttgtgggctcaagtgatcctcccgcttcggctgggattacagcccacgaagtgctgggattacaggcatgagccgtcactccggaccctatagaccttagtatcccctc

SEQ ID NO: 442806 - DNA, 5205 bp, Homo sapiens
  misc_feature (2)..(2): n is a, c, g, or t
  misc_feature (4)..(4): n is a, c, g, or t
  misc_feature (4907)..(4907): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaatcacattctttctgccaacatagttttatcctgtctcagtaggatactccataacacaatagcagtacaccactaggctcttaaacgatcaagaacaatttttttcatggtgaaatcaaataacgcagttttggaaacctataaccgcattttgtgcttgaattacgtgccccacactgtggcttaggatacttattggggtataatgaaaatcttactgaaagttaatttcacattcttacaccccaaaatctgcattgccattgatgcatatgcaccacattattatatttccacatcagtttcttgtgtgccaaataagacccatgctatgcatcttggtttccatgaagtgaaaatacatagtaagaatgcgagaaatataaatcaggccaggcacggtggctcacacctgtaatcccagtactttgggaggccaaggcaagcagatcacctgaagtcaggagagaccagcctggccagcatagtgaaaccccatctctactaaaaatacaaacttagctgggcttagtggtgcatgcctgtagtctcagctacttgggaggctgaggcaggagaattgcttgaatccaagaggcagaggttctattaatggagatcattccattacactccagcctgggcaccaggaacgaaactcgttctcaaaaaacaaaacaaaanaaaaaaaacgttggctgggcatggtggctcacgcctgtaatcccaacaatttgggaggctgaggcaggtggattacttaaggtcaggagttcaagaccagactggccaacatggtgaaaccctgtctctactaaaaatgcaaaaacattagctgggtgtggtggtgcatgcctgtaaatcccagctacttgggaggctgaggcaggagaatggcttgaacccaggtggtggaggctgcagtgagctgagatcacgccatcgcactccagcctgggcaacaagagcaaaactccatctc

SEQ ID NO: 442807 - DNA, 3997 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaactcctgacctcaagtaatccacccgcctcggcctttcaaagtgctggattacaggcgtgagccgccacgcctggccgcattatcatttcttaagataccagttgtgcttatttagttcatgtagttattgaatatcactcagtatgtcaaacataatgtctaacacttccatagagataaccttgttttctgttttttatttgtatacttattgtacataaaagtgagaatcgacactgatagaaagcgaggccgagctcc

SEQ ID NO: 442808 - DNA, 2747 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagactgcatgcagttcatcaatttggctgcttttccatagctgctatgaaaatt

SEQ ID NO: 442809 - DNA, 1325 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctgtcccccgcccacttcatccctcaggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagacctgctcaggagatggaaacattggctgctgctccttggcatctgctgccccaaacctcatggaagagtctccagccgtctccgcctgtcgaggtccctcggccatttcttccattctgcttttgccactttcatgggggtgtgtgataagcgagtgggttctatcttctaagattgttctcagcataaccgtaaagacacctaacaaaatccttctgtcattgatcctcagtcttacatggggtgcgtattctgtttttccaggcttcagcacagaaatacaagtactgcatgttgtcacttacatttggaatctaaaccaataaaactaatagcagcaaagagtagaatgtgggttaccacaggttggggactggagggaatagggagatgttggtcactgggtgaaaacattaggagtaaatgataggtttttgagatgacttatatggtaataggcttgtttccatcagtccatattgtatacctataacagaatatcagtttgtttcctgtaaatatatataactataatttgtcaatatagaatttttttaaaaatcatattccagttcttattgtgttggttctaaataaaaatgcttctttctcttaag

SEQ ID NO: 442810 - DNA, 861 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggaagaagtctggaagaagaggaagaggaaagaaaaggagtcagggatggcccttactcagattccatctcccgtgatccagtgacatgaacttgggaagaggctgcactgggcatggtcctgggaagggctcacacccagacatggatggagacggggtgagggtcctgtggtgtcagtgctgttgggcagcagggattgctcaggggccgcatctggatgcactgtcagcgctgtgtaaaccatgataacagaagctgcccatgaagtcaggtgcacacgtacctgctcactggcatagaaaagaacactaaggggaaagctttcctgcctcattggtaactgcatttgaagccgaacaagaaacaggagctcacttttctacatccttgttggagcatgctgggaatgaagacaggtggatcttttaactttctcacttctataaagaatgccacacagggtgctgcatggtggctcacacctgtaatcccagcacttgtggaagccaaggtgggaggatcatttgagccccagagattgaggctgcagtgagccatgatagtgccactgcacttcagcctgagtgatagaacaagaccttgtctcaaa

SEQ ID NO: 442811 - DNA, 5322 bp, Homo sapiens
  misc_feature (2)..(2): n is a, c, g, or t
  misc_feature (4)..(4): n is a, c, g, or t
  misc_feature (5024)..(5024): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaaaacaagcttatgaacaatcagcttggagtaagctttcattctcatctgcctgaactgcagctatttcaaggtgaggggaaaatgtatgaatgtaatcaagttgagaagtctaccaacaatggttcctcagtgtcaccacttcaacaaattccttctagtgtccaaacccacaggtctaaaaaatatcatgaacttaaccatttttcattactcacacaaagacgaaaagcaaacagttgtggaaaaccttataaatgtaatgaatgtggcaaggcgttcactcagaattcgaaccttacaagtcataggagaattcatagtggagagaagccttacaaatgcagtgagtgcggcaaaacctttactgttcgttcaaatctaactattcatcaggtcatccatactggagaaaaaccttacaaatgtcatgagtgtggcaaggtcttcaggcacaattcataccttgcaactcatcggcgaattcatactggagagaaaccttacaagtgtaatgagtgtggaaaagcctttagaggacattcaaacctaactacccatcagttaattcatactggagaaaaaccgttcaaatgtaatgaatgtggcaagctcttcactcaaaattcacaccttataagtcattggagaattcacactggagagaaaccttacaagtgcaatgagtgcggcaaagcctttagtgttcgttcaagcctagcaatccatcagacaatccacactggagaaaaaccttacaaatgtaatgaatgtggcaaagtctttaggtacaattcatacctcggaaggcatcggagagttcatactggtgagaaaccttacaagtgtaatgaatgtggcaaagccttcagtatgcattcaaacctagctacccatcaggtcatccatactggaacaaaacctttcaaatgcaatgaatgcagcaaggttttcactcaaaattcacaacttgcaaatcatcgaagaattcatactggagagaaaccttacaagtgtaatgagtgtgggaaagccttcagtgttcgttcaagtctgactacccatcaggcaatccattctggagagaaaccttacaaatgtattgaatgtggcaagagcttcactcaaaaatcacaccttagaagtcatcggggaattcattctggagagaaaccttacaagtgtaatgaatgtggtaaagtcttcgctcaaacatcacaacttgcaaggcattggagagttcatactggagaaaaaccttacaagtgtaatgactgtggcagagcctttagtgatcgttcaagcctaacttttcatcaggcaatacatactggagagaaaccttacaaatgtcatgaatgcggcaaggtttttaggcacaattcataccttgcaactcatcggcgaattcatactggagagaaaccttacaagtgtaatgagtgtgggaaagcctttagtatgcattcaaacctaactacccataaggtcatccatactggagagaagccttacaaatgtaatcaatgtggcaaggtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaaatgagtgtggtgaggtcattaggtacaattcactcctttcacatcagttaatttcattcttgacagaatccttacaaatgtagtgacagtggccaatccctcatgagttgaagcattaatagatatgagaggccataagcaagagacatcatgtaaacatatgtggcagagggtctatccaggcctcgcaggttactaggcatcaagatttatatctttgatgaaacgaaacaaatgtaatatgcatcctgaggccattacccagtgaccgatggtaagtgaggattcctaggaggaataacagtctctggtttccctgtttgcctttgatattatacactgtagaatactcacaagtccaaatatgctaaaaattatatatttttaactcacatacgaaaaggttgcaggatatttgtaggcagtcagttaccttcaccttatgaaatgtttcactgagttatttgaggttttttggaaagcctactattgcgtttcaatgtgaactttgaaatcttattgtgcatccttacacaccttccatggtgctttcttggaaagatcattgggatggaaggatcattgattgggtgaagatcattgattaggtgaaggattatttctatccaatttgtgaagaaggaggactttgcttttaaaattaagtatcatctgaattagcatttgggagtggcgaaaaacaatgtaaaactatgatgtcactcaccattctgataatgttcagggtgcctttctcctaccaggagagtactgtggcttagaggaaagaaatggtctatcaactgaacatgaaatggagcaggccaagaccttaggacattgggatttttgtgggaggagagtaataggtaattagacactgattgtgtggtagaaatactgcaggggaaaaggtcgccctcttatgcatcaaagagcaatacctgttgtttagcaaagagtgatgaaaaattgatcttgttttgaaattgaagagagaggccaggcgcggtggctcacacctgtaatcccagcactttgggaggctgaggcaggtggatcacctgaggtcgggagttcgagaccagcctgaccaacatggagaaaccccaattgtactaaaaatacaaaattagccgggcgtggtggcaggtgcctgtaatcccagctacttgggaggctgaggcaggagagtgcttgaacccaggaggcggaggttgtggtgagccaagatcatgccactgcactccagcctgggcaacaagaacaaaactccatctaaagaagaaaaagaaaaactgaagagagagtagttgtcagagtgaagagtttaatcaacagaagtagagtaacatattctttagtagaactcacattatctgcttgaagcacattttgctaatgttttattcagaatgtatcatagatataatgttttaactaataaaatagaatggtttttctctatgaatgaatcacattctttctgccaacatagttttatcctgtctcagtaggatactccataacacaatagcagtacaccactaggctcttaaacgatcaagaacaatttttttcatggtgaaatcaaataacgcagttttggaaacctataaccgcattttgtgcttgaattacgtgccccacactgtggcttaggatacttattggggtataatgaaaatcttactgaaagttaatttcacattcttacaccccaaaatctgcattgccattgatgcatatgcaccacattattatatttccacatcagtttcttgtgtgccaaataagacccatgctatgcatcttggtttccatgaagtgaaaatacatagtaagaatgcgagaaatataaatcaggccaggcacggtggctcacacctgtaatcccagtactttgggaggccaaggcaagcagatcacctgaagtcaggagagaccagcctggccagcatagtgaaaccccatctctactaaaaatacaaacttagctgggcttagtggtgcatgcctgtagtctcagctacttgggaggctgaggcaggagaattgcttgaatccaagaggcagaggttctattaatggagatcattccattacactccagcctgggcaccaggaacgaaactcgttctcaaaaaacaaaacaaaanaaaaaaaacgttggctgggcatggtggctcacgcctgtaatcccaacaatttgggaggctgaggcaggtggattacttaaggtcaggagttcaagaccagactggccaacatggtgaaaccctgtctctactaaaaatgcaaaaacattagctgggtgtggtggtgcatgcctgtaaatcccagctacttgggaggctgaggcaggagaatggcttgaacccaggtggtggaggctgcagtgagctgagatcacgccatcgcactccagcctgggcaacaagagcaaaactccatctc

SEQ ID NO: 442812 - DNA, 1206 bp, Homo sapiens
  misc_feature (2)..(2): n is a, c, g, or t
  misc_feature (4)..(4): n is a, c, g, or t
tngnccacagacccggaagtggatcgtgcggagcaagcatcacaccatggcgtatgagtgttcctctgtgtagactcaacctgcgcctcgccgtcccccattcgcacacccgatgcccgggggtcgctacggacttaaaatctccgcaccgcaccctccacctcagaaacgttcctggatccgaacactgccccctgacgacctagagagatcccggctcccagcccactgagtggcttcagcctcgctggcacctcccaactcctggcctctctgcacgaggcgcctgccccgggccccgcctacaggggacccagctcttcttgcagccactggaagctgatcacctggagtgaagacctcacacgaagaagtctggaagaagaggaagaggaaagaaaaggagtcagggatggcccttactcaggtacggttgacatttagggatgtggccatagaattctctcaggaggagtggaaatgcctggaccctgctcagaggatcttatacagggacgtgatgttggagaactactggaaccttgtttctctgggactgtgtcattttgatatgaatattatctccatgttggaggaagggaaagagccctggactgtgaagagctgtgtgaaaatagcaagaaaaccaagaacgcgggaatgtgtcaaaggcgtggtcacagatatccctcctaaatgtacaatcaaggatttgctaccaaaagagaagagcagtacagaagcagtattccacacagtggtgttggaaagacacgaaagccctgacattgaagacttttccttcaaggaaccccagaaaaatgtgcatgattttgagtgtcaatggagagatgacacaggaaattacaagggagtgcttatggcccagaaagaaggtaaaagagatcaacgcgacagaagagacatagaacctaccaagattaaacagtaaagaaatccaaaacctaaacagaccaataacaattaatgagattgaagctttaataaaaaaactcttccaggaaagaacagcccaggacctgatggcttcattactgtattttaccaaacatttcaagaagtaataccaattcctattcaaactattctgaaaaataaggaggagggaatactttcaaactcattctatgaggccagttttaccctgatatcaagaccagaccaagatacatcaaaaaaaggaaa

SEQ ID NO: 442813 - DNA, 291 bp, Homo sapiens
ttgttccctttcttctttcagctttgcttcagtgccaacctatcagaaaagccttccctgcttattccgtataaatatttccactcttttctctttttccactctacgtaataacatcttttaatttttttttgagactgtctctgaaaaaaaaataataagatcataggccagtctcagtggctcgcacctgttaattccaacactttgggaggctgaggtgggaggatcactggagcccaggagttgtagacccatctgggcaacatagcgagattctgtctctatttt

SEQ ID NO: 442814 - DNA, 4120 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcaggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442815 - DNA, 491 bp, Homo sapiens
  misc_feature (52)..(52): n is a, c, g, or t
  misc_feature (113)..(113): n is a, c, g, or t
  misc_feature (116)..(118): n is a, c, g, or t
gtggaatgatgacagtatagggggaaggggagctggagaaaggttggttagngggtacaaacatacagttagatggaaggaagaagctcaaatgttggatagcagagttaggnggnnngggtagaagacctaccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442816 - DNA, 376 bp, Homo sapiens
atctagattaattatttaaaaatttaaacatgaggttgacggatatattcctccaaaatagaaaatagcttgtttggatgaatcagactcaaattgatatacagctttttttttttcccaaaagaaatactattattaccatttttgtcttatttggaactttctgtttttctatagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaaa

SEQ ID NO: 442817 - DNA, 4186 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagctttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442818 - DNA, 4066 bp, Homo sapiens
tgccagtcagcaggcggttggggcgggcccgctgcggggctggggcgggtgctttctcgtttaacacgaaccagacaggcagttaggtttgaacaaatgaggatccggaggtccagagagtataggtgcagagagtaaagtgacaggtctaagtagtgaagtagccggggctggaaccctcgtcccaggcagtggggcacaggctgtcttcatcgcggagatggcagtcggggagcgtcgctccagaaagggccagggagtgcgggagcgtccgtgtgcgaaagagaacgccccagtgggatgctttggctgtgtctctcccttttggaggagttggtgggtggtggagtcgttaagtcccgtgcagttgttagtgcagggtaagaatgggctcctccagagagggtagcgccgaataggatttcgtttggaggcaggactggtgcctcaaggtctctttaaaaggaagataagcgagcggcctgaaactaccgggtactccctctgggcccatgggcttcatggtggccgacctttgggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagctttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442819 - DNA, 4185 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442820 - DNA, 4328 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacatattataggctaaaggtgtgggttctgagaacagggctcacgagtccagggattcatatccagcgttgaaaagctgaaagttgagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442821 - DNA, 4186 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctggggacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442822 - DNA, 4186 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaatccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442823 - DNA, 3596 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatattcaattactgagctgtctcctgtgttgattatctagcttatggggcttgttcaaccgtttcgtgggggggacccaatttttgccggaccctgggaggggggc

SEQ ID NO: 442824 - DNA, 4240 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442825 - DNA, 4059 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442826 - DNA, 4187 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaatgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442827 - DNA, 3655 bp, Homo sapiens
agagtagaggagggatttgagagctattgaggatatcttggtgactgagggtacatgggaagtttggacaaaaggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatgagtcataaacattctaagtgcatacggccatttcttccttatttcaatgtgtcacaacaatttgccacctttgttcttaagggatcttttagtgaaataccagagctacaggtatggtataccaaacttggaaaaacatccgaaagatttctttttaagcagctggattctctatggctccttgacagcgatggcagtttcacactgagcctgcatgaagatgagctgttcacactcaccactctcaccactggtcgcaaaggcagctacccgcttcctccaaaatcccagcccttcccaagtacctataaggatgatttcaatgttgattacccattttttagtgaagctccaaactttgctgatcaaactggtgtatttgaatattttacaaatattgaagaccctggcgagcatcacttcacgctacgccaagttctcaaccagagacccattacgtgggctgccgatgcatccaacacaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442828 - DNA, 2161 bp, Homo sapiens
cccggaattgccagttccaaaagcaaccaatcagtattataggagactacaactggaccaatctgactataaagtgtgatgtttacatagagacccctgacacaggaggtgtgttcattgcaggaagagtaaataaaggtggtattttgattagaagtgccagaggaattttcttctggatttttgcaaatggatcttacagggttacaggtgatttagctggatggattatatatgctttaggacgtgttgaagttacagcaaaaaaatggtatacactcacgttaactattaagggtcatttcgcctctggcatgctgaatgacaagtctctgtggacagacatccctgtgaattttccaaagaatggctgggctgcaattggaactcactcctttgaatttgcacagtttgacaactttcttgtggaagccacacgctaatacttaacagggcatcatagaatactctggattttcttcccttctttttggttttggttcagagccaattcttgtttcattggaacagtatatgaggcttttgagactaaaaataatgaagagtaaaaggggagagaaatttatttttaatttaccctgtggaagattttattagaattaattccaaggggaaaactggtgaatctttaacattacctggtgtgttccctaacattcaaactgtgcattggccatacccttaggagtggtttgagtagtacagacctcgaagccttgctgctaacactgaggtagctctcttcatcttatttgcaagcggtcctgtagatggcagtaacttgatcatcactgagatgtatttatgcatgctgaccgtgtgtccaagtgagccagtgtcttcatcacaagatgatgctgccataatagaaagctgaagaacactagaagtagctttttgaaaaccacttcaacctgttatgctttatgctctaaaaagtatttttttattttcctttttaagatgatacttttgaaatgcaggatatgatgagtgggatgattttaaaaacgcctctttaataaactacctctaacactatttctgcggtaatagatattagcagattaattgggttatttgcattatttaatttttttgattccaagttttggtcttgtaaccactataactctctgtgaacgtttttccaggtggctggaagaaggaagaaaacctgatatagccaatgctgttgtagtcgtttcctcagcctcatctcactgtgctgtggtctgtcctcacatgtgcactggtaacagactcacacagctgatgaatgcttttctctccttatgtgtggaaggaggggagcacttagacatttgctaactcccagaattggatcatctcctaagatgtacttactttttaaagtccaaatatgtttatatttaaatatacgtgagcatgttcatcatgttgtatgatttatactaagcattaatgtggctctatgtagcaaatcagttattcatgtaggtaaagtaaatctagaattatttataagaattactcattgaactaattctactatttaggaatttgtaagagtctaacataggcttagctacagtgaagttttgcattgcttttgaagacaagaagataagtgctagaataaataagattacagagaaaattttttgttaaaaccaagtgatttccagctgatgtatctaatattttttaaaacgaacattatagaggtgtaatttatttacaataaaatgttcctactttaaatatacaattcagtgagttttgataaattgatatacccatgtaaccaacactccagtcaagcttcagaatatttccatcaccccagaaggttctcttgtatacctgctcagtcagttcctttcactcccaattgttggcagccattgataggaattctatcactataggttagttttctttgttccagaacatcatgaaagcggcgtcatgtactgtgtattcttatgaatggtttctttccatcagcataatgatttgagatttgtccatgttgtgtgattcagtggtttgttccttcttatttctgaagagttttccattgtatgaatataccacaatttgtttcctccccaccagtttctgatactacaattaaaactgtctacatttacaa

SEQ ID NO: 442829 - DNA, 1696 bp, Homo sapiens
gctcttctcgcctcatctcacataagggaaaactcaggctccaaaagcaaagtgattccaccaagatgacaatggaatcgggacctggtgtccaagcctggtcctcgcacgaggtagatactccctgagatgctggggaagagccatggtagggccactcatggccctcttcctttggcggaccttggaatccaccttccctgcgttaaagtgctccaccaggtgacgccggaagagaagccagcagtaagtacatgtgaaatccagtagctgaccacagacacgcgagcgataagaaaaagctcgctgcttcttttctcaacactccgccagctgcgtcagaggcccttgacccgcactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcggcgggccgcgccgcggtgcccttgctgctgtgtgcgctgctggcgcccggcggcgcgtacgtgctcgacgactccgacgggctgggccgggagttcgacggcatcggcgcggtcagcggcggcggggcaacctcccgacttctagtaaattacccagagccctatcgttctcagatattggattatctctttaagccgaattttggtgcctctttgcatattttaaaagtggaaataggtggtgatgggcagacaacagacggcactgagccctcccacatgcattatgcactagatgagaattatttccgaggatacgagtggtggttgatgaaagaagctaagaagaggaatcccaatattacactcattgggttgccatggtcattccctggatggctgggaaaaggtttcgactggccttatgtcaatcttcagctgactgcctattatgtcgtgacctggattgtgggcgccaagcgttaccatgatttggacattgattatattggaatttggaatgagaggtcatataatgccaattatattaagatattaagaaaaatgctgaattatcaaggtctccagcgagtgaaaatcatagcaagtgataatctctgggagtccatctctgcatccatgctccttgatgccgaactcttcaaggtggttgatgttataggggctcattatcctggaacccattcagcaaaagatgcaaagttgactgggaagaagctttggtcttctgaagactttagcactttaaatagtgacatgggtgcaggctgctggggtcgcattttaaatcagaattatatcaatggctatatgacttccacaatcgcatggaatttagtggctagttactatgaacagttgccttatgggagatgcgggttgatgacggcccaagagccatggagtgggcactacgtggtagaatctcctgtctgggtatcagctcataccactcagtttactcaacctggctggtattacctgaagacagttggccatttagagaaaggaggaagctacgtagctctgactgatggcttagggaacctcaccatcatcattgaaaccatggtaaacttttgttgttgctattggattaactcacttctttactattggaaaaataaaatataaaactgaaa

SEQ ID NO: 442830 - DNA, 2029 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 442831 - DNA, 1534 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442832 - DNA, 2567 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatggtgaggccacagccctctcctgtccatttttcttgggacatttattttccccccttgccaattgctggggctgggaggacacgcagtgctggctggcatgtccctaggcatcgagggttgccagagcgacatgagagtgtggcatccccactgggccaggaagaggggacttaggtccgagaactctgattggtgacttccccgctgggagttctgtccctcacccttggctgtctttcaggtgaatgccacctgatcagtgtgagtgggggtgggaagcaggagatgccgtcgctacgtgagaccagcggcatttagtgcctgctcgctccctccctccctccctccctccctccctccctccccagctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442833 - DNA, 2199 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442834 - DNA, 2124 bp, Homo sapiens
cggttttttgctagttcacagaaagaccatttttaatatgaaaagagaaaaacaatttgaaggccccacaatttgttgtgtaacaacataatttcaagtaaagtgaatgtgattaaaacatcttgatttcacaaagccattcagaggaggcttcgacaaacgcaaagcgacccaaaccctggagggtcacatcccggctgctacaaacctcggcggggcggccccgctcttgcggccgggacagcgcagcggcagcaggggccgcaggggacccgcagattggcacgccgctccccatccccgcagcgcgtctgcaccggagactctgcggggattgtagccggagggcgggccgggctccgaggcgctgctcaggcattggggtttgtcctcatgagctccacgtcggcgtgcaccatctccctcaccagctcatcgaaagcgacccggggcttccagttcagcttctgtttcgctttggtgcagtcgccctgcagaaagtcctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcagtgccttcctcctcccgctttccccaactgctccactcgaggaaaccggaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442835 - DNA, 1416 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442836 - DNA, 2499 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatggtgaggccacagccctctcctgtccatttttcttgggacatttattttccccccttgccaattgctggggctgggaggacacgcagtgctggctggcatgtccctaggcatcgagggttgccagagcgacatgagagtgtggcatccccactgggccaggaagaggggacttaggtccgagaactctgattggtgacttccccgctgggagttctgtccctcacccttggctgtctttcaggtgaatgccacctgatcagtgtgagtgggggtgggaagcaggagatgccgtcgctacgtgagaccagcggcatttagtgcctgctcgctccctccctccctccctccctccctccctccctccccagctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442837 - DNA, 908 bp, Homo sapiens
gtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442838 - DNA, 1310 bp, Homo sapiens
taggttttgggggagcaccccttcccctttggaggctgagcacggcatgtgtgggcaccttggtcacactccagagctcgcttcatccccacgagcggcacctgatctccagtgacggggagactgaggcctggcaaagaggacctgttgcctttgtgtaactggccccagcatgggggaggcattggccccagcatgggggaggcattgaccccaggcctgccaggcctggcagccacagcctggctaggtggaggttactgccttccgcaccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 442839 - DNA, 615 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccaaggagagtgctgccaagtgcacgcgcttagaacggagtacttgcacagcatgacgcaaggggc

SEQ ID NO: 442840 - DNA, 405 bp, Homo sapiens
gctgggggaagggatcagcctcaggtattgggtggtgcccacgcctgagcacattgccatgtgccttgccgcacgtggtcctcctggcagcccttggcctggcctctgtttgattgcggaggagaccggggcccacaggagagtgagtgagggggctgaggctgggagccagaaggtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtactttgcacagcatgagcaaggggctgctgcgggcgcagccgacatcagcaccctagaccagaagctgcg

SEQ ID NO: 442841 - DNA, 769 bp, Homo sapiens
gctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccaca

SEQ ID NO: 442842 - DNA, 2309 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctcgcagctgggggcgggctgcggccgctgattaaaggccgcctagagcagcctgtgtggcgacaggtgcccagaagcccaggaagccggtcagtgcccgccccagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 442843 - DNA, 2163 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctcgcagctgggggcgggctgcggccgctgattaaaggccgcctagagcagcctgtgtggcgacaggtgcccagaagcccaggaagccggtcagtgcccgccccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 442844 - DNA, 1911 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctga

SEQ ID NO: 442845 - DNA, 1711 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442846 - DNA, 1634 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442847 - DNA, 1316 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccactaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442848 - DNA, 971 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaatgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaaaacaaaaaaaacaacaagaaagaagcaaggagcaaacagagcacgaaaacaaacgaaaaaaagcacagggggggccacaaaaaagagaccggcgagaggccaccggacacaacacacacacaaaggagtacagcaaaggggacgcccaacagggcaacagacaacac

SEQ ID NO: 442849 - DNA, 887 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtacttttgccagcatgggccaggggcttgtgcgggcgcaccccacttaagcaccagctaattttgggtttttttccagtcttccaaccaccaaccttgtgcg

SEQ ID NO: 442850 - DNA, 933 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgaggtaaaggtgtggatggcccaggtgggcagtattgacgggcttctcttggtcctagttctggagctggtaggggctggggtgtcactccccctctgatgctggctggggtgtgacaccccacttggggatctggctggccaatcaggggccgggcagcatacgggcaaggggcagctgtgtcccaagggtgctggctgttgcccaaggccccgggggtgagtatgaaggtgggatgtgggcctcagagcagacgggccaggcacagaggagggtgagcacctagggtgctccatgggtgggtaggtaggcgggcaaaaatggaggagccagggcagacaggtggggcaggattctgcgcggtggggcttgtcctggcctctgtgcctggccccgatgtgcttctgggg

SEQ ID NO: 442851 - DNA, 2692 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaactcaacaattcaacaaccacaaaatctatatccacctacaatcctacttaaatcatcccacttccactcctccattttcatctctctccaacccaccctccaataaccccgcggggggcccacttccccactccctcctacagcccctataccacctactccc

SEQ ID NO: 442852 - DNA, 2453 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaactcaacaattcaacaaccacaaaatctatatccacctacaatcctacttaaatcatcccacttccactcctccattttcatctctctccaacccaccctccaataaccccgcggggggcccacttccccactccctcctacagcccctataccacctactccc

SEQ ID NO: 442853 - DNA, 1933 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtctgaggtcctctaggtcgctccagc

SEQ ID NO: 442854 - DNA, 1769 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttcctggctgagatttcaaatagtcctccccacctcaactgtcaccaactgactaagggactctatcacattgagcacattttcctaaggccctgctgtctgccgaggagcgccaagaagatgtacttgttacacacgaactgccaatccccagctccgttctgcccctcgtgtcagtcacca

SEQ ID NO: 442855 - DNA, 2794 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaactcaacaattcaacaaccacaaaatctatatccacctacaatcctacttaaatcatcccacttccactcctccattttcatctctctccaacccaccctccaataaccccgcggggggcccacttccccactccctcctacagcccctataccacctactccc

SEQ ID NO: 442856 - DNA, 1493 bp, Homo sapiens
ggtaccaagatgggtagatggagcggttcacgaagcagtgaggcgtcgccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaactcaacaattcaacaaccacaaaatctatatccacctacaatcctacttaaatcatcccacttccactcctccattttcatctctctccaacccaccctccaataaccccgcggggggcccacttccccactccctcctacagcccctataccacctactccc

SEQ ID NO: 442857 - DNA, 990 bp, Homo sapiens
ctgcccacgaagtggctgccccaagtggaagtgggaagattgcttgagctcaggagtttgagcacttcgtgggcagcgctgcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcctaaaaaaaaaaactcaacaattcaacaaccacaaaatctatatccacctacaatcctacttaaatcatcccacttccactcctccattttcatctctctccaacccaccctccaataaccccgcggggggcccacttccccactccctcctacagcccctataccacctactccc

SEQ ID NO: 442858 - DNA, 277 bp, Homo sapiens
agttgtaatgaggaataaatgagtgaatactatgtgaactgcttgcagtgttggctggcacataaagaagtgctcagtaaatgttagctatagttgtagttgttactactactaccactattcctactcctatgacttctttctcctcctcctcctttacctctttctcttattcactttttgccctcctatatgaagtagatactaagttctactgattctgtaacctacatattgcttttgtttttgagacagagtctcgcgctgtctcccaggc

SEQ ID NO: 442859 - DNA, 929 bp, Homo sapiens
  misc_feature (929)..(929): n is a, c, g, or t
atggggctagagagctatttccacaccagaccacagatactcacgttccagtcaggtttgcctgagtaggtctataagccttcctcatcaaaactgcaagtaatatgaaaaccaatccctaaagtatgctaaataatatacccatgcctgccatagaggtaacaatatttgacagcaatcaacaggaatataaagttctttgtgacacggtacctcttaataatacatactggtcacaaatacactgtagctagtatcatttgttttcagggagaaacctctgtttactatgagttttctttggaatctctgtacagaaaatactaatgaaatggactactcccacatctaaacgtcccaccaacagtttatctgaccaggagacaaatcaaacaaattaaggggagaaaagagatgtaacggcaaagtttctctactccagactagttgtttttttttttctccaaaatgctaatggcagaacttctgctactctgtactgtaccgcacctctgggtacatccagctgtgaccacaccacaactgtatcgcatccagcaacctaaagtactcttgtggttgctcatgtaaatacttggaaaatatctgcctcttccggactctccccttcacattatagaaatgctcaagtctcaaaaacaaaacaagaaacttccagagaacctattcacttcaaattacggagatcccctctctccttgatccacaataaacttctggaaaaggtcgcctacaggccttaaagaatcaccacgattttcctcccctatacaagcaaagcttttcagacaaaaatcttaacagtagaaatgtacccacataaacaagctggccctcaggcaaacattactactattcacacaaacatggggcccttgtcgacgcggccgcgaatttagtagtagtan

SEQ ID NO: 442860 - DNA, 849 bp, Homo sapiens
  misc_feature (849)..(849): n is a, c, g, or t
atggggctagagagctatttccacaccagaccacagatactcacgttccagtcaggtttgcctgagtaggtctataagccttcctcatcaaaactgcaagtaatatgaaaaccaatccctaaagtatgctaaataatatacccatgcctgccatagaggtaacaatatttgacagcaatcaacaggaatataaagttctttgtgacacggtacctcttaataatacatactggtcacaaatacactgtagctagtatcatttgttttcagggagaaacctctgtttactatgagttttctttggaatctctgtacagaaaatactaatgaaatggactactcccacatctaaacgtcccaccaacagtttatctgaccaggagacaaatcaaacaaattaaggggagaaaagagatgtaacggcaaagtttctctactccagactagttgtttttttttttctccaaaatgctaatggcagaacttctgctactctgtactgtaccgcacctctgggtacatccagctgtgaccacaccacaactgtatcgcatccagcaacctaaagtactcttgtggttgctcatgtaaatacttggaaaatatctgcctcttccggactctccccttcacattatagaaatgctcaagtctcaaaaacaaaacaagaaacttccagagaacctattcacttcaaattacggagatcccctctctccttgatccacaataaacttctggaaaaggtcgcctacaggccttaaagaatcaccacgattttcctcccctatacaagcaaagcttttcagacaaaaatcgtcgacgcggccgcgaatttagtagtagtan

SEQ ID NO: 442861 - DNA, 222 bp, Homo sapiens
catttcctgaaggaggtatccaagaagcagaagagcaaactaagcaaagccatgcgcaggaatcccaagtggtttggcaatgctggtgaaaaatgtgtttcgtggtaaggaggatgggggtggacaatgggaggagggagatggggctagagagctatttccacaccagaccacagatactcacgttccagtcaggtttgcctgagtaggtctataagcctt

SEQ ID NO: 442862 - DNA, 553 bp, Homo sapiens
tacctcattcataaagatgaaaaaccagccagcattgactgagcacttagaagacctcacaccaggatctctgtgaataagatctcatttcaccttcgctacaatgctgggagatgggaattacaccattcgcacatcaggaaacaggggctgtggattcttgggtaacttgcccatgctcagaaactgatgcagctgaggccagaagccaggtttgaatcattcataagctgagtgttttcactgagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttctgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatgacagcgtt

SEQ ID NO: 442863 - DNA, 1595 bp, Homo sapiens
tccccaggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcaatcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacgtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttctgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatgacagcgtt

SEQ ID NO: 442864 - DNA, 1407 bp, Homo sapiens
tccccaggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcaatcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagctgcgattccttcaattcatttatgcttccgatagacgtccctgccatccttgatgccttaccagaagaggacagactagaaacagtagaacggagcacctggatctgctgctgtatctgtgacgacagagtcggggtatagcacaaagaaggccaccagccctgcatgacaagagctccggcacattaggaagactcttggtcccagagttcctccctacccgctatttcctgaactcctgttactgaagacccattcctttagctttgcgctttgtttctattaaactacctctggggagggaaca

SEQ ID NO: 442865 - DNA, 1252 bp, Homo sapiens
tccccaggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcaatcttgagcatgaaaccacctgaggccttagccatgtctctagattatgatcctctgtatgtttttgtaagtgacaactggcagaagccttgttttctgtgttcctttatttcagcaattactctataggaaacagagcactcattgggaatattttttctctttggaatttcaagtgttaaacaatatctgacctttaatattgtttgccaacctttattttttggagaatatcagtgattccgtcttttagcaattcctgcatttttaatgaaaataattttatgatcttttctaaatatctataatatgtacatataggccaaagaagaaattgaaaaagaaattagcaagtatttttaagtgaatgaaaatgaaaacaaacaaaaaatctgtgggaaattaacagcactacacacctacattggaaaagaagaaaagtttcaagttaatgtcctaagctacccctt

SEQ ID NO: 442866 - DNA, 1502 bp, Homo sapiens
tccccaggcaggtgcaccttggtaaagatcctatgtcttttaaacttaaaaaagagcttactgaagagtggcaaaaagcatgtgccaaatataagctagacagaggagatcctattttggatgaggaatttcagcgacttaaaacagaagttagccataaacgggttgttcgcaatcaagaagagaaaatcaaggaatttcatcctacttttgatccactcattaataacacttggctcagcaggtccagggcacaaaaacggtttcaacaagtagcacgcaaggtcatgattcagggacgattattcaatatgctgagtgctgttcgtgaaatggacaaagagagtatactgagaaagattggccaagcaaaacaatcgatagcacaagaggcgaatttcttcaaattcttcctgaggcggatcagtcaggatgattataccagccggttctctgtgtcgcccaaggaggtgctgcccttcgctttcccagactgcagcccaccccaggactccaacgagttggctcctgatggccttggactggtcccaattaagtcttcagaagttcaaatcaagcagagttattccttcttcaatctgcaggttcctcaactgtacaaaattaagagatatcagccattctctgtccacaagtcttcaacaagttacagacctcaaaagcttgcccgagccctaaagcaaggagctgaggatgaagtcaccaccatcacagcccttccgaaacaggactccacaactcagctctctggcaaaacatcaatcttgagcatgaaaccacctgaggccttagccatgtctctagattatgatcctctgtatgtttttaatcccaacccaggattatttgctgtaatgcatcctctgacctatgcagaaacgttgatagattaccatctatgctctcaccccaagtacaaattcaccaaagagtcccgccacgggtccagcattcctgtcacccaaaagcagtttctccatcacacggacattattcccggaataatgcactggaaaagcttccagtccctggttctctcctccctgccggacccctccaagatggagaccacaaagagtgagctctgtgagcagaatgtagaagttatgttgactccagaaatgatcaaagtggaattccctatgttgaactacaaggacatcaggaaggagaaagaagtgaaagatcaagcacaaccagcagagaaggccggagagaagctgctcgaggagatgaggaacctgcggggcaaagcactcaacacatacctgattctagaatgaaagtcaccagtaggtcagtcccttccatttgctttctgtgggccactgtggccccttgcgtccatttacatgccagccatctctgcaattaaagtttctggataaaaaaatgaaatgtagaggatgtatatatcttttaagtgataattataaatcttatatttaaaaataaaatggagttaggatgatgacagcgtt

SEQ ID NO: 442867 - DNA, 2755 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatgattgc

SEQ ID NO: 442868 - DNA, 3582 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagaaaaaaagtt

SEQ ID NO: 442869 - DNA, 2470 bp, Homo sapiens
atatgtataggtcgatactgggtttatttcgtcacgatgggtggcagtagtaatgtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagaaaaaaagtt

SEQ ID NO: 442870 - DNA, 3044 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagagtaagtatcaccaccactctgtagcatcctagtcttaaaaattactatgtacagaaatctgtgttcttcacacgtgtgtgtgtgtgtgtgtgtgtgtgtgtgtgtgtgtttctagcatgcaaataactcttgaggtaaagaaataggcattttgattggtggtccacaggtctccactcatctgccgttttctcacgacagcccagatatcaaccgaccagtgcttctcaggatcggaatcctaagaggatccaccattggaatcttccatatcagtcgt

SEQ ID NO: 442871 - DNA, 2666 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtggaaaaaaagaaagagaaagagaaacatcgaacacaagggggggcgccagcaaagagtatgccccagggggggccaaagaatccgggtaacccaggtttcatgcggacaaaggggggcccaaagtggggagccgacctataaggatgacggcctgggcgacggtgtataaaacagcgcgagggggacacatgggtcaacgccgtgggaactcccgcagaaagggaccccctatacacggcgggggcgcaccaaactggggcacaacgccacccagcagagatcaaacgccccagggcaaaacacacgacttcacaagcgcaaacgagggaagaatacgggctatcagccgagccaaagacgagccaaacgagacaga

SEQ ID NO: 442872 - DNA, 1571 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaattttttttttggaatttagtagagatgggatttcaccatgttaatcaggctgatctagaactcctgacctcaggtgatccacccgctcggtctcccaaaggactgggattacaggcgtgagccattgcacccagcgtctaaacttttaataagga

SEQ ID NO: 442873 - DNA, 567 bp, Homo sapiens
cttttcagcttcagttttctcattttacacaaatataacagacagtgctcttgaatggaacaaaaaaaatcaagtttgaatttcatatcagtttaatagcctgagctgggtaatggtcttactctgatcctggggaatgtacagatgtagaatgaatgaaaaccagtacatgaactgcattgtattatttttgatcctggaagttttaaatgttttttctctatgatgttctatggttgctattgccagacttgatacattttcttcttttataaaggattcttagtttatagtcatgtaagtgtacctataaatcccacctggttttcctagaactaacttattttggtgattttgttctcttagctgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgt

SEQ ID NO: 442874 - DNA, 319 bp, Homo sapiens
gtctgtgcagacatgataagaatagctagtatttattgtgttcttactgtgtgtcaggcactctgtcatctcatttaactttacaatcatcctgtagggtagatactattattatccccagtttagaggtgaggaaactgagcatagtctataagtgaagatgttgggattagaactcagggagaagtaatctagagttgccctaacctaaatttttctgtatattactttttcttattattttccttagaatggtcctttatgtgtattttatattttatatgagtagagtttgcatatagagaatataccttatatt

SEQ ID NO: 442875 - DNA, 669 bp, Homo sapiens
gtctcttcctgggctgtgaacaacactgcctggctttgcagtaagggtggcaaaaatgcactccctggccacccagctggtgtctcaataggtcatgtgcacctaagtctactgggctagtggagtggcaataacagacgatataaggtaggagttgcattgtgtctgagaagatgtggagaggactgtgaacctacttttgtgcaacactgaaaagtatatgcttcctttcagttaattgacatgagtctttgaagaatagactcacattctgagtctgtgagtgagtattttgtcattctacacccttacttagcaagctaaagtcctgaaaaatatgattcctgcattttcttgatttccagaataatatagcgtattccttaaaagaaagtggtttcatgaaaggtgttactttcaaaaaattaatcttcttttccttttttaaaaaataggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggtaagatttagatggatttaacaaggggtttttttccccatgtaacattttcct

SEQ ID NO: 442876 - DNA, 411 bp, Homo sapiens
cagatcttccttattccatgtagccacatagttacccttatcttcctctgacagaagaccgggttgaagcttgctctctggagaggctgagccagagaagttctggattctggaagaccagaaacaaatcagagtctggtgagatgctgcactaataatggggattaagtgaaagtctggtcgtcagatttataatctgcaaacagaagactggaatttcttttcgtcaaaactgagtaaccaaagagaacctaaggatactgaaaagtgaaatgactggccacgcctctatagtgaggtccactattcaaaatgcttcacgcattgcacactgagcttgcattcagtgtgttagtgactgttaattataaatggataattaaagatcatcaaatatttaagacctaaaga

SEQ ID NO: 442877 - DNA, 3293 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagttaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagaaaaaaagtt

SEQ ID NO: 442878 - DNA, 2292 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtgga

SEQ ID NO: 442879 - DNA, 3077 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacaggtattgatcagtcctgtcaattgggtttagtggttaggggtagcgtaatacgctgtaaggttcctgcagaggattcagggtttaatcactgtctagctgtcactttctagctacaggacctcacaagtcagtttgctgctctgtagttgcttatccctaataaaatggatgtaatatctcctcctgctctgtgagaattaagatctaatggattgaaaagactttgtatactatggagagatttttattggtggtaatggagcatgcttttaatctcatattctatgtcaagtattagatctttagagtacttgtcatttagcatgtataataagcttcttgaattcttctgtattagacatagaatacattattcagtgtttggaagatacttggttttcagtatgtgaatagacactaagattgagaaatatctcttgtaaatacagagtagtataaagtttttttaattttgtttttaatttcaagtttttccataaactttgaataaaaacatttatcattcaaaactgtt

SEQ ID NO: 442880 - DNA, 2826 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatgattgcaaaataactgattttctgactacattattccttctgtatttattagttatcactccaaggtagatctttcatttctttccctcttatttattcattcatttatttattatactgtggaatcatgtattctcatttttatacagtgggttaaaatctgttactataggctgggcatagcagcttaac

SEQ ID NO: 442881 - DNA, 1455 bp, Homo sapiens
  misc_feature (12)..(12): n is a, c, g, or t
tctcagacggcngaggtcactgcatcccggcgcggcccgcagaagacgagcgccgctgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagataacaagaccatcaggaaacaatggaaatcgaagaagaagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaattttttttttggaatttagtagagatgggatttcaccatgttaatcaggctgatctagaactcctgacctcaggtgatccacccgctcggtctcccaaaggactgggattacaggcgtgagccattgcacccagcgtctaaacttttaataagga

SEQ ID NO: 442882 - DNA, 2648 bp, Homo sapiens
ggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcttggaagagaaggacgctggtgggggctgagatcagagctgtcttctggcccagttgcccccatgctgctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaa

SEQ ID NO: 442883 - DNA, 379 bp, Homo sapiens
gaaggaaagaatgcaacatttcttttgctttggatcacatctacctctttgttcaggatgtatactttgacttgaaccattcattatgtatttttgttcccgaccttgattatacacttcagatgtgaaattgttcacagatggctcagtgatggtcttttgttacttatctagggaaaaatattttgcatctttgcatgaatatctaataagaaaagaaattatctgtacactaggaaagattaatggatcggggcaatgtaaatctactgaggatattctgatagtgagcctggtccaaaatatttgatcagtgaaaccataatatttcgatttctttgcagcctgttttgtgcaacttccaagtcaagattatgaa

SEQ ID NO: 442884 - DNA, 427 bp, Homo sapiens
gtttcaatacacaaaagcaactccaaagtgaattgtttgagatttaaggtttgcttaactcttcccaaccctttggcttttagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtatgatccaattcttttgaaggctaaaatgaatgcgagaaatttgcaaagcaacagtgttgggcaaatttctaccatgtgtagtgaccaaccatctgagaatgcatgcttgcaagaagatgtaaggatctcagaggcta

SEQ ID NO: 442885 - DNA, 1995 bp, Homo sapiens
  misc_feature (23)..(23): n is a, c, g, or t
ccgtgcgctccgaagacggatantggaaagctgcaaaagtcaccagaaagaaacagggctgccttagtaaagtacagaggtgaagtggagcaagatggcagaatagcaagctcctttgatggccatccgcacaaatgtctacacagaaaaagcaccttcacaagaaccaaaaatcagcctgttttgtgcaacttccaagtcaagattatgaacattttcagactttttgcaagacagaattcaatggattaacaatcagccttatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaa

SEQ ID NO: 442886 - DNA, 384 bp, Homo sapiens
tattttttgtagagatggggtctcaccatattgtccaggctggtctcaaaccctggccacaaccaacctttctgccttggcctcccagagtgctgggattacaggcatgggccaccacacccagcccctgaagctatcttttaaaaaaatttttactagcacttaggtgatttctgctttgacctaattggtactctccttgcaaaatttgccagtgaaaaaaacttactaatgtctgattttccatgagatgttctccatatagttacatatcatatgtaattactacattcaatattattgacataacaagggtatggtgccgtcttgtttggggagtttgacattgagcgaagatgcttcctggatgggtgcggtggctca

SEQ ID NO: 442887 - DNA, 626 bp, Homo sapiens
agaaagccattttcagttcgagcgccaagatcgtgaagcccaatggcgagaagccgacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 442888 - DNA, 1089 bp, Homo sapiens
  misc_feature (630)..(630): n is a, c, g, or t
agaaagccattttcagttcgagcgccaagatcgtgaagcccaatggcgagaagccgacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacaagcnaaacaaacagaaaacaacaaaacaacaacaacacacacacttgtggcgggcgcgcgctctctggcgccctccggagagaaagactttctctataaaacaccaattcgcggtgggggggcgcgcgggggcgccccaaggaggcgactcaagtgtgaaacaagtggtgcgccaatatagcgtgtgtccccaaggagagaaaacccggggaccccacgaacaccaagggcgccgcggaagaactctcacccaaaattaaaaaccgcgccgggggggcgaaaaccagagagaagcacgttcttcacgagaaacaaaaatctcccgaagagcggcagcataagagaagaagaccgcaaaaaacagaggggggaaaaccacacatcacaaaaggaggaaggcccacaagagaggaacgcgcggaaaactcccagatatgagagcccgcgcgtcccacgggtggac

SEQ ID NO: 442889 - DNA, 426 bp, Homo sapiens
  misc_feature (90)..(90): n is a, c, g, or t
  misc_feature (140)..(140): n is a, c, g, or t
tactgtgaatatatactttttatttagtcatttttgtttacaattgaaactctgggaattcaaaattaacatcctttttcgttttcttcntatagacaccagaaaatttttcaaccttttttaccacattgtcctgctgngctttgtccaaacgaaccatgataagtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcaca

SEQ ID NO: 442890 - DNA, 572 bp, Homo sapiens
agaaagccattttcagttcgagcgccaagatcgtgaagcccaatggcgagaagccgacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggaattcccagagtttcaattgtaaacaaaaatgactaaataaaaagtatatattcaca

SEQ ID NO: 442891 - DNA, 2301 bp, Homo sapiens
  misc_feature (507)..(507): n is a, c, g, or t
  misc_feature (580)..(580): n is a, c, g, or t
  misc_feature (596)..(596): n is a, c, g, or t
  misc_feature (602)..(602): n is a, c, g, or t
  misc_feature (1020)..(1020): n is a, c, g, or t
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtaagttctgtttttgtccttaaaagaattaaatttgaccatgtgtggtggctcatgtctgtaatcctagtactttgggaggccnaagtgggaggatcacccgaggccagtagtagttcaagatgccagctctaaaaacaaaatttaaaaattatctnggatcaatggcatgcncctgtngttccagctacttgggaggttgaggcaggagggctgcttgcacccatgagttcgaggctgcagtgagttatggttataccattgcactccagcctgggtgacagaatgagaccctgtctcttaagaaagagaattaaatgtattgtttgttaaaggagtgacataatctatatataaaataattcccatacaaatatgaaaattcatattcattttcaggtttctccttagacttaaaaaaaaaaactttacaactcttttgtacttctgagactttttttttttttttgagatggagttttgctattgtcacccaggctggagtgcagtggcacgatctcagcttgttgcaacttctgcctcccatgttcaagcgattctcctgcctcagcctcctgagtagctgggattacaggcncctgccaccacgcccagctaatttttgtattcttagtagagatggggtttcaccatgttggccaggcctgtctcgaactcctgagctcaggtgatctgcccacctcagcctcccacagtgctgggattacaggcatgagccactgcacccagccaacttctcagactttaaaaaaatctttacattatttttcttgagtctgtaagtttgagaatgtcacatactaatttattttctataagttctctaaagagatgaactttccaaagagtagataatactcactttgcagcattccatgacattgtagatcttattgatgtctcccagattatgtctcatgttttaggccatagacattctctgagtgggtccttccagtaattccagaatagacttggcaacaggacactcaaaaggcagtgtttgggaatgggatccttggagactttcaagccaaaaggatattgcccaaacaaatctcagtttaaatgttgtgatgaggttgattccttttttcccaatttataatttctggaagtagttgtccaagagaaataccttccctgtatagttactgaaagcataaaatttggtgtatctggtaaggtcccattttgaggtattctgtcctgatttccccataaaacattgtagtagcccagacattgaatacccctgcatctaaactctgtttctcccaggccatataaaacattcctagcaaacagcttctttcttatgataggtcttgcaaaagagcaagctgtattattaagagctgactatgaaagtaggaaagcctggggttgagtgcaggctttcacacttcctaatcttgtgatttcctgccaagctacctaactactctaagcattgattttctcatctataaaatgggggtaacaccagccctcatggttattgaatattacataaaacaaagtatggaatgtgagggcgatctggctgtgacatctgtcaccccattaatcgccagggttgattcggctgatctggctggctaagtggctgtccccttcctccctcaccactccatgttcatgcctcccaaagctgtgttctcagtcaaagaggacaaccatctccactagaagaggaccagtctttggtcaagggtatacgagtagctgcgcttccctgctggaacctccagacaagctctcaagtccatttgtaggagaacatagggtagtcaagcttccaagattccagacacatccaaatgaagtgctgcatgtggcagtctgcctttcttaa

SEQ ID NO: 442892 - DNA, 2687 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagtagtttcagtctcctccccaaggaccttcttcatccaacaagttgcaaaatttgaatatcccttctgtactatattgggtgagctgtaaatgtaatgactaaaagaaaagccacagaagaaagaagaaatggtcaaagacgtggataatatgcaaattggccattatattagaacaatcaagagctgactgtgttattaccactttctgcctagggtggccaaattccctagaaatagacatcaagccagttaacttcacttttccctgcaatttgtatgtcactaacatttaaatgccattttttaaaaacataaccacaataccattatgacacctaaaaaacattaacattaacttaatatcatctgttttcagtttttcccacttgtctcaaaatgtatgtttacaatattatcagtttcattactgatgaatattatatgcctcctgataagatgtactgaggaggacagaatatcacttttgtagatttataccaaaaatgcataatttggatataatgaagaaacagtcaaatccaagtttgaggctgggcacagtagctcatatctgtaatcccagcactttgggaggccaaggcagaggatcacatgaggtcaggagttcaagatcagcctggccaacgtggcaaaaccccatctctacgaaaaatacacagattagccaggcatggtggaatgcacctatagtcccagctacttgggaggctgaagcacaagaatcgcttgaatccaggaggcaaaagttgcagtgagccgagatcacaccactgcagttcagcctgggcaacagaccaagactctgtctcaaaaaaagg

SEQ ID NO: 442893 - DNA, 1667 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaa

SEQ ID NO: 442894 - DNA, 1677 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaa

SEQ ID NO: 442895 - DNA, 1806 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaa

SEQ ID NO: 442896 - DNA, 2262 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaaaaagaagagaaaaagaaaaagaaaaaaagaaaaagaagaaaaagaaagagagaaaaagagaaagaagaaagaggaggaagaagagaagaggagagaggaagaggagaagaaaagagagagagagggaagaggaggtgacactaaagacaaaagaagcaaagacagcacatgcagagcagggcagacgcagataaatagattacgtaacataaaggagatgcgcgacacgcacaagaacggaagagaactgactgcagcctctcgcggaggatgacagcgaacgcacgcaaaaaggaagacaagcgagaagggcaagagaaagaggagggcggcgggcaagcggccagccacacaaggcggaggggaaggacagaagagtcgaggtgcagagcagagtgctgcaaggaggcaccaaaaacaggagagggggaagcgacagagcgagaggcagagcag

SEQ ID NO: 442897 - DNA, 1174 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggtaaggctttcttttcataacttaaaatttgattgcagtactgcaaacaaaatctttctgaggaccaactaatatttgaataagcaattattgcaaaagtcaaaatgtaattgaggggcacattcaagtagtgattagctttgaaatggttagagtacaagacatttgatttgacttgtcttttatttgacagtgtttatgtagtaaaaatgtcatgtctctagaactcacagtcatcttgacc

SEQ ID NO: 442898 - DNA, 1586 bp, Homo sapiens
ctggtggcatagggcagacacgcctgcagacattctctgggaaagggcagcagcagccaggtgtggcagtgacagggaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 442899 - DNA, 1639 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 442900 - DNA, 1793 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaacacccctgccctctgctcctcttacccacatccctcctcactgatgtgactccagaaacagggtatctgacagcacagggttaagattagtttcataattggagacgctgtcggagcatcccatctcttgtacccagtggtcccagagtcgacg

SEQ ID NO: 442901 - DNA, 1997 bp, Homo sapiens
  misc_feature (1471)..(1471): n is a, c, g, or t
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggtcacgggggtcacttgctagggaccaattgtctagtggtgttgaggaacgtaaaaggcggaaagnggttggccctacgacactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctg

SEQ ID NO: 442902 - DNA, 1573 bp, Homo sapiens
cttatgcatagtacgaggccgggtgttagactgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 442903 - DNA, 1117 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcagataagttggagcaggggttggtcaaggccacctctgcctctagtccccaaggcctctctctgcctgaaatgttacacattaaacaggattttacagtaaa

SEQ ID NO: 442904 - DNA, 1032 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctctgcctctagtccccaaggcctctctctgcctgaaatgttacacattaaacaggattttacagtaaacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctg

SEQ ID NO: 442905 - DNA, 509 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcactctcctcgtggccatgcacgtggctcaccagcaacacatagagaagaaaatgctctgcctctagtccccaaggcctctctctgcctgaaatgttacacattaaacaggattttacagtaaa

SEQ ID NO: 442906 - DNA, 868 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagggcgtcaatcacacttccgagggcggttggcccgccttccttggtcagggggtc

SEQ ID NO: 442907 - DNA, 1889 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaaaaaaaacaaaacaaaaaaaaaaaaaacaacaccaacaacaaccaccaaaaagaccagagaaagaaaaagaacagagacacagagaaaaaaaaaggacaagaaagcacaaagaagaaacacaacaagaaagagcacgagaaaacacaccacaaacaaacccacaggaaaaccgaagaaagaacaacacaaaggaagagaagagaaagagaacaaaacagaaaccagagaaaaaaaaatacaacgaacacgt

SEQ ID NO: 442908 - DNA, 1962 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctg

SEQ ID NO: 442909 - DNA, 1259 bp, Homo sapiens
agcatatgactccccagcgggggcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctctgcctctagtccccaaggcctctctctgcctgaaatgttacacattaaacaggattttacagtaaa

SEQ ID NO: 442910 - DNA, 1569 bp, Homo sapiens
ggctgtacgctccggatttaatgggattgcagcagcagccaggtgtggcagtgacaggcaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaa

SEQ ID NO: 442911 - DNA, 539 bp, Homo sapiens
ccaccacacctgacctcgtaaaattcttaaacgatctatactcagttgtcttacagttgcctagattcttgttccatttaaagaaactgaaatttgaaatcacaaatgtggattatggatatgatgggttatggatatgatatatttgtaatgaatatgcaagagagaacatttgaaacattaattagtagaaatgtacttaaagaagaggccttggttttttaccgtaatattggcaggtgacatgtatttgttttgagtaaaaatcaaatatttcagttacatttttaaaattacctgatatactgtactttttcatgtaaccagtcagccctgagtcctatttgtgttagataagtttttaccaatcccagaaggagatagaggacaagcttttatatgcttcggctgaagaaaacctttctccaaagaagtaattatctgatcctcctataaagggccagatagtaaatattttagattttgcaggctgaagtagaatcaagggtaatacgtacgttctgatataacaagagaga

SEQ ID NO: 442912 - DNA, 307 bp, Homo sapiens
tcttggcctctaaggactccacagactgttagacatgtgtgtcctctggacggtagctccccagggacaaaagaattgttgacttcctgtcctgcactctaggatttccttctgggacagttcttctaaatcagacctgtatccctcttgctgcaccctatgagcacggtgctctaagatcgcacatccctgccttgcttcccctgggtctgagggagtctaggggcttgggattaggagcaggagtgtttccctggccctcccccatggtctgtgtgttgtcccccccccaccccccacccccacc

SEQ ID NO: 442913 - DNA, 677 bp, Homo sapiens
agaggcgctcctcacttaccaggcggggcggccgggcagaggcactcctcacctcccagacggggcggccgggcagagacgcccctcacctcccagaaggggcggccgggcagaggcacccacttcccagacagggcggccgggcagaggcgctcctcacttcccaggcggggcggccaaaattttatccttttaaaattaatttttctaccacatgattgaattttttatttgaaactccagtgaattttgtactgttacaaagacatgaaaatctttgataatggtcttaattaaataggaagatctattaatgttctaacatgttttgtttgaaattaaaataaatacagctggtataatcactgttctgccttccacacactggaaataggcatagatttagaaagcagtgcagtagcaaatgaggtctaatatgatttctaatgaatttggatagtagatctggatcttagaactctctattttgctgtcactgagtccagctatgcttatcctatgtggtttgttctatgatcaattgacatttcttcttaggtttgaaataattataaggaaagtaatttcaatagctcaattatggtcattaagaagaaagcatcttagaccagcgctttatcagtacatcatatttagacgtacagaatttctatgtg

SEQ ID NO: 442914 - DNA, 2607 bp, Homo sapiens
gactgcggtgagggggcgagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442915 - DNA, 2783 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaattagagacggggtttcactgtgttagccaggatggtctcgatctcctgaccttgtgatccgcctcggcctcccaaagtgctgggattacaggcgtgagccaccgcgcccggcagatttttacaacctattctgaagaaaatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442916 - DNA, 2333 bp, Homo sapiens
gccctgtgctgagtgctggggatacagagctggataagacatggtccctgccctcaaggagtactctgtttaatggaggagatggacaagaaagctcctgttgcagtgcagttggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442917 - DNA, 1251 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaaccttt

SEQ ID NO: 442918 - DNA, 2061 bp, Homo sapiens
tgtctccattttgccccataacagtcttgtgagatagggatcattatccttacttcacatgtgaggaaacaggttcagacacagggacttgcccaacattacagagctgataaagagcgaaggcaggatttgaacctttcaaagactgtctggggctggagtgccgccctggctctcaccatttcccttgaccagcggtgctcagcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442919 - DNA, 1937 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaagccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442920 - DNA, 1124 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtgtatcctgcctcgagctcctgggccacatctctcctgcaatctgcacactgtagtgagagagagaaagagggtggtcatgaccctaggcatgctgtccagacccttgagtgtaggagagccacaagagggccaccttccctaccctttcccacagatcagagccactcttaggtaaacagtggttacaacctggctgggtctgagaggaacctgaggctgcagctagtgaggctgtgctagcagacctgagatctgaccagtcacaggggaagaggaccctctaatgggatccctcagtttagcatcatcctctgttctgaataacacttgtaat

SEQ ID NO: 442921 - DNA, 2645 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442922 - DNA, 2452 bp, Homo sapiens
gactgcggtgagggggcgagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatgttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442923 - DNA, 2237 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttggaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442924 - DNA, 2382 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatgatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggcgcttgggccactcaggacccctccggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaaaatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaacatttatcttgctttcttcttcccacctctttccctggggtccccaggggtgtcttgcctttgttaacccccatcggagacctgagggtctgggggtggttgggcctgcctttctgctgttcccagctgttcccctgctgacatccctaggagtggtggaatgccaggctcctgtcctgtggcctgggggcctggggcatcattgggcctgccttcagactgaggttgctctatgttctcactgcctgaggacagtgtcccgccaccacctgccttcctgaggaccacactcaggctcggcttctcttccccagctgtggcttcccatggtaccctgctgcttatgccacctg

SEQ ID NO: 442925 - DNA, 681 bp, Homo sapiens
gactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaagaggtgagagtttaagtagtgggaagagcccaggttttccgaagctaatgggttggaatgcatgggaggagcataggtttagactgaaaaaattcctggttttgtctgccaaaattatttggcatggggcctctctaaaacaagctgattggtagaacccctcccctatttatcgattaaaaacctcaaatatttctgtatagcttactttatggtttcaaggtatttttatattaaaggcaaacaaaaataagca

SEQ ID NO: 442926 - DNA, 1620 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttca

SEQ ID NO: 442927 - DNA, 941 bp, Homo sapiens
  misc_feature (779)..(779): n is a, c, g, or t
  misc_feature (795)..(795): n is a, c, g, or t
  misc_feature (799)..(799): n is a, c, g, or t
  misc_feature (802)..(802): n is a, c, g, or t
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattgggatctatatgggaaggggttggaaactcacagactttgtgagancgggtctgctggtcgnaggnatnatttgagtgtaatagtcctgagaggttacctggggcgccctggtatggtgaagggcctattgtaaaaaccggtttggggaaaggggtgctcttagttcttagtttttttaattatttatctatttcttttttttatcgt

SEQ ID NO: 442928 - DNA, 592 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacaggtaagctggaaggagaatgtgcagttgtaaaagtatttgtgatctgtttgtacaggaaacggttttaaatgtaattgagcacctcagagaaaagtcgggctttaagggtgttt

SEQ ID NO: 442929 - DNA, 685 bp, Homo sapiens
cctttaagcagctacgggcagagtcctgtggagctctggggggcgtgggagacaggcaggaaacccaccgggcaggcaggcaggagcagattccagagtgggtagagaattccatctgcgcccctttttttgtccccatcaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacaggtaggcgcgcatcaacaagtgtatgtgttacagtgccgatgtcttcagtgggtgacagtcacagctggaagtgcccgtgtcacctctaggacagtgggctgctgttcgcctcgggccgcgttctggactggctcctgctgcagtccgtccttatataggagcctcgccctctttggggatgcagtgacctgggacttagtctgtggggagccatgttcaagtcatcagtaggcagcggaacagccacaaaccccactctgagaaacgcactcacgcgcctcagcggggctgtggtcgcaggaggagcggtccctggttagcagtacttctgagtgactccaaggtagagtggccgacagtggtcaaaggtcgcgtgcccttgagagctgtgc

SEQ ID NO: 442930 - DNA, 1514 bp, Homo sapiens
  misc_feature (1477)..(1477): n is a, c, g, or t
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatctaccgctggcnctttaaaactggaatggaaaaaaaataaatctttgcc

SEQ ID NO: 442931 - DNA, 1858 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaaatagtacctaaaaaaaaaaaaaaaaaaaaaacaaaaacaaaaaaaaaaaaaaaaaaaaaaaaaaaaaaaaaaaaaaaacaaaaaaaaaaaaacacaccgcggcgccgaccctccctcctgggggggggggaaaagagaagggggggaggggggcggcgcgaggcggccagggggccccggcacccccttttttggatagaagagaggagggatataatttcgatggaggtcgcccccactcaagagaaggaggtgagccataataattggtgacgaagagaagggaatagagaatcacctcctttttattgtcctccttcctcgacaatacagaaagacaaagagaataaacagaaaaagcaacagaaggaagaaaaacacaatgagaagcagatcacatatacaatagaaaccaaacaaggaaaatgatgacgatgaaaaagaaacgtacaaaagatagcaaaaagaacaaaataaacaaaaaacacacaaagaaaaaaacaaccataatgaactagaaaatacataataataattctttatataatattaattatcttatatatatgatattatacatgcaatgttattactaataaaatattatacatataaataatataaataaaacaactattctaacaaacattatatacaataaatacatatctattatatctttaaacactattatcacatactaacacaactggaacaacagacaactcaatctcagaaagcccaagtatattaaaagctacaactacaacactctattatacg

SEQ ID NO: 442932 - DNA, 1184 bp, Homo sapiens
ccccagcactgagttggaacaaagcagaagctttctgtgtggaaacagcattcggtttggtgatccttctatgtaagaatacgatctgatgttttctaagttaattaatacaaaatacatattgataaaacactagataaaagatcacagatagattcattacaaaatttttataatgggtataaaatcaccagtccccttgcataagctctaaccacagtgagctaccctgtttcagctgtaacacagtctcctgtgaatcacaagatacattaactactggataatttttctgtgaaggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttca

SEQ ID NO: 442933 - DNA, 1287 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattgggagacggggcttcgccacgttgcccaggctgatctcgaactcaagggatggctcacctcggcctccaaagtgctgggattacaggcgtgagccaccgcgcctggcctttcctggctgcttatactcactcacctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctatccgaaccgttccagcaacactcaaacttgtcaaagatgcagtcgttctcatagagagagcagagcttgctgcgcaggtactcgtggacctggtgggtctccaccggcgctgctctccatgttgaggtcccacaccttcaccgacaggtagtctctggtcatca

SEQ ID NO: 442934 - DNA, 1103 bp, Homo sapiens
agtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggatggctcacctcggcctccaaagtgctgggattacaggcgtgagccaccgcgcctggcctttcctggctgcttatactcactcacctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcat

SEQ ID NO: 442935 - DNA, 535 bp, Homo sapiens
cttcaagtcggggttgagggatggttcctggtgtggcaccattgctacctcttggaaatggaagggcaggctggttagatatcaagagcagattccagagtgggtagagaattccatctgcgcccctttttttgtccccatcaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacaggtaggcgcgcatcaacaagtgtatgtgttacagtgccgatgtcttcagtgggtgacagtcacagctggaagtgcccgtgtcacctctaggacagtgggctgctgttcgcctcgggccgcgttctggactggctcctgctgcagtccgtccttatataggagcctcgccctctttggggatgcagtgacctgggacttagtctgtggggagccatgttcaagtcatcagtaggcagcggaa

SEQ ID NO: 442936 - DNA, 257 bp, Homo sapiens
gatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcatcagattactgtatttacatatggtttaaaatcagacgtcatgatagcttcttaatgaaaccagg

SEQ ID NO: 442937 - DNA, 915 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctgggccttcgtggctcgagagactagaatcgcagatacgaaaaccccgcagc

SEQ ID NO: 442938 - DNA, 2358 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcaaaaaaaaaaaaaaaaaaaaaaaaaaaaaaaaaaaaaaaacaaaaaaggggggcgcggcccggcccaataatgatctccccccggggggcccccagtatcttacgcccacaccccccagctttttgtttaaccaaggggcccccccattaggaggggcctccgtataataataaggccgacagcgcaagccggggcccgcgcggttattacaacaccctcgcgggaggcggggaaaacagcggtgtcaacgccggggacagtctgtgggaaagcaaccccttcctcctcgtgggggggggcaccaatttatgtcggcgcaacacaatctcccctcaccgaaagaatttataagggcgccctccaggagggaaacattataaacacttctccagcgttttactggtggcgtgttatcaacaaccggcgtaaaatttgctctgcggcgataaagaaaaatttgggcgacgcgaggaatttattatttggggcaacatatttttttttatccgccggcgggctcttagtattataaataaagcgggccctagcatcattcacacatcagcacctcagcccgtgccctcatgacatcaatcaacaagcatccatatcatgcagactcacattacaacatgcaactcatcataacgtactacgtgagatactcatgctaggatctccctacgtacagaacactcaacactcaccgcaccgcactcatacaccgacgcagctata

SEQ ID NO: 442939 - DNA, 1214 bp, Homo sapiens
tacggtgaggtacagctacgggtgaggtacagctacgggtgaggtacagctacgggtgaggtacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttca

SEQ ID NO: 442940 - DNA, 1272 bp, Homo sapiens
gaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattgggagacggggcttcgccacgttgcccaggctgatctcgaactcaagggatggctcacctcggcctccaaagtgctgggattacaggcgtgagccaccgcgcctggcctttcctggctgcttatactcactcacctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcat

SEQ ID NO: 442941 - DNA, 575 bp, Homo sapiens
aaagaaaaaaaaagatttgggaactgacaagtatagttggttaaaccactaaaatggtagtgatcaactaaagaacaagtacgtgtagacagaagcccaaagactaagccctgggataggcctgtgtttaaggataaaaagaggaggaaaatccagcacaagagatggaggaagagcagtcagtgagctagaaggaaaaccaagagttcctaaagccaaatggggaacatgagcacaccaaattcttcagagaagttgaataagatgaggatgaggaactcatcactggctttggcacatagaggtcactggtccacggtttcattgaagtgttgggatgagagcccatttggaacgggctcaaaagagaacaggaagaggactggagacaaggagtccagacaactctttcaaagagtttagctgaaaaggggtacaaagaaatgggaccatatctggacacggtatatggtcaagagagggagctcttgcagctggcaagtgttctgaagtgctctgtggtgggacacttaggttactattagcacaattattttgctgttataaatagtgct

SEQ ID NO: 442942 - DNA, 3141 bp, Homo sapiens
ctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtgcaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaaaggcaaagggaaaattgatattcaagcatatctaagtcaatggcaagatgagcttttcaaaaaagaagaaaacattaaggatttaccaagaatgaatcagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttgggagggagttggtacagtcagcctttgggaagaatccactgtgaacaaagcttaacacatgggggcttcatcgctcatagaatatgttatttttcaaagaagttcaagaattttccaagttgagcctttgaaaatcccataaattggttttagctaaacacttactagtagtgtctttaaattatttaatcaaccttgtccttttcaaggaaattacccacttaaagagatagttggtaaataaacatcctatgccttttctcagaaatgatttgctgaactatgtccatattttacagcttagataatagtttatatggaaactattatacatctgctattgtgcaatgattgttaaattatactgaagtagctctagaaagacacatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatgaaaaa

SEQ ID NO: 442943 - DNA, 405 bp, Homo sapiens
gagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttccc

SEQ ID NO: 442944 - DNA, 1631 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacac

SEQ ID NO: 442945 - DNA, 817 bp, Homo sapiens
ttaatatatagaagaagttgtgtgcttaattgttttgcccaagtttctacagttggggttggttgtgtctggtaattagatacaattacatgttagataaggtctcagtaatatgtaccaaaaaatataaagtacaaaaataaaaattccattttctttttgttccaggttctctgggagatgctaacaagggaggtcccctttaaaggtttggaaggattacaagtagcttggcttgtagtggaaaaaaacgaggtaagactacgtttctccattcaggtacatagatcagaaaacagtattggggttttgcaaaagactttttcatcttcttcaaattgaaagtaagttcacgcttatggaaagattagcagtaggagctaacacaaagggtcaaagtgatgttattcctcatgaatggaccctttacatctaattgttgcagcttcacgtcgtgatgctgtagatcaaaaattgtacaagtactgtactagtttctcagtctcaattgtaaaacctaggggtttgttcttagtgatgaaagaagccattgcgtccaaggtaggggaacagtttaactccatctcctgcgtttaggacatcttttttactggccgggagttgatatatctgtaagagaccttcagctacttcaacttacctctcccagcaggagtcactatagtacaagaaactgtcgcttagatgagaatttcaaaaataaaagaagaaaaaatagtttcaaaaaagggaaaaattacagttttgccacctacgttgaacactacattgaagatgagctcctcactggaattgg

SEQ ID NO: 442946 - DNA, 3391 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaattta

SEQ ID NO: 442947 - DNA, 2276 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaa

SEQ ID NO: 442948 - DNA, 2776 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442949 - DNA, 3712 bp, Homo sapiens
acctatggaattgtgaagtttgctgctttttatgtgactgtgactgaatgggtcttgttaagcccaaagtgactcaaagggcatgacctgtgtataactctctggtgattatatacaggattgaaaatcctccaagcctgcttttaaagttgtagcacagcagttttagacatagaaaggctggttttccatcttgtcatacaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442950 - DNA, 3360 bp, Homo sapiens
acatatatcgcaagttgcctataaacatacagtgacatatggttttatatttaatatttaagttccgacttgccccctcctactgtagttctgtttagatattttatgttttgttgcattagttgtactgaacctgacttctccgttcactacagttccctttcaagaaaaagtatgagtctttagagattacagatctaaacataaattgtcacttgtcacatattaatcaatggaagctttaaatttcatgccttatgttcttaaaataactctattatgacccttcagatacggtgtttgctgacattaatgaataaatccctgttttattttgttttgtttccctctgtctattgtagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442951 - DNA, 1450 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgaggtaagactacgtttctccattcaggtacatagatcagaaaacagtattggggttttgcaaaagactttttcatcttcttcaaattgaaagtaagttcacgcttatggaaagattagcagtaggagctaacacaaagggtcaaagtgatgttattcctcatgaatggaccctttacatctaattgttgcagcttcacgtcgtgatgctgtagatcaaaaattgtacaagtactgtactagtttctcagtctcaattgtaaaacctaggggtttgttcttagtgatgaaagaagccattgcgtccaaggtaggggaacagtttaactccatctcctgcgtttaggacatcttttttactggccgggagttgatatatctgtaagagaccttcagctacttcaacttacctctcccagcaggagtcactatagtacaagaaactgtcgcttagatgagaatttcaaaaataaaagaagaaaaaatagtttcaaaaaagggaaaaattacagttttgccacctacgttgaacactacattgaagatgagctcctcactggaattgg

SEQ ID NO: 442952 - DNA, 852 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctaatgggacactccctgtgttagcatctcccgtcgaccggccgcgaa

SEQ ID NO: 442953 - DNA, 3886 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442954 - DNA, 3879 bp, Homo sapiens
  misc_feature (3850)..(3850): n is a, c, g, or t
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacatctctctatcatgcggctctatcccgcgaagttcatgatagatttacaaatattacagcataaagacaactgagacaagagcgacaacagtatctgtgaataaaagctcagagaatagggcagaatagtatcgcacactacgctcgtatggactgagaccaggtcgagtcaatgcagcgaggacaacgcaggtatgacctggtatagcatacatatagtaaagaacattactgcgagttgccaacggtaacctgttacagtaatgccacgggcaatgtcaggccatgtagagtcccggcnggaataaagagatataagcgagaccacaa

SEQ ID NO: 442955 - DNA, 3833 bp, Homo sapiens
gcagagctccttgggatgagtaggaagtgctgctgcaggttttgtctgggggatatctgagccatttctctgtgggcagctgtgtttcaaagtctgggcaggttgttgttgaattttgcgtgggctgccaggattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagagattaaccattccaagcagttgccccagaagttttgctgaactgttacatcagtgttgggaagctgatgccaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442956 - DNA, 2201 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagttttttgaaaactgcggtggaggaagttttgggagtgtttatcgagccaaatggatatcacaggacaaggaggtggctgtaaagaagctcctcaaaatagagaaagaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaa

SEQ ID NO: 442957 - DNA, 3618 bp, Homo sapiens
aggtggtgctgttgccgtgactgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccaggcagaaatactcagtgtcctcagtcacagaaacatcatccagttttatggagtaattcttgaacctcccaactatggcattgtcacagaatatgcttctctgggatcactctatgattacattaacagtaacagaagtgaggagatggatatggatcacattatgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtccttggttggaactttcccatggatggctccagaagttatccagagtctccctgtgtcagaaacttgtgacacatattcctatggtgtggttctctgggagatgctaacaagggaggtcccctttaaaggtttggaaggattacaagtagcttggcttgtagtggaaaaaaacgagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgctgctgccttcctttgagattggtgcatggacggaagacgatgtgtattgttgggttcagcagctcgtcagaaaaggtgactcttcagcagagatgagtgtatatgcaagcttgtttaaagaaaacaacattacagggaagcggctgctgctgctggaggaagaagacctgaaagacatgggcattgtctccaaggggcatatcattcacttcaagtcagccattgagaaattaacccatgattacataaatttgtttcacttcccaccactaattaaggactcaggaggtgaacctgaagaaaatgaggaaaaaatagtgaacctggaactggtttttggttttcacttgaaaccaggaactggcccacaggattgtaagtggaaaatgtatatggagatggatggggatgaaattgcaataacctacataaaagatgtgacattcaacactaacctacctgatgcggagattttaaagatgacaaagccaccatttgtaatggagaagtggattgtaggaatagcaaaaagtcagactgtggagtgcactgtcacatatgagagtgatgttagaactccaaaaagcactaaacatgtccatttgattcagtggagtagaacaaaacctcaggatgaagtgaaagcagtccaacttgccattcagacattattcaccaattcagatggcaaccctggaagcaggtccgactcaagtgctgattgccagtggttagatactctgaggatgcggcagattgcatccaacacttctttacagcgttcccagagcaatcctattctggggtcaccgttcttctcacactttgatggccaggattcctacgctgctgctgtgagacggccccaggtgcccattaagtatcaacagattacacctgtgaaccagtccagaagctcgtctcctactcagtatggactgaccaaaaacttctcttccctacatctcaactctagggacagtggcttttccagtggcaatactgacacctcttcagagaggggtcgatactcagacagaagcaggaacaaatatggacgtggtagtatatcactcaattcttctcctagaggaagatacagtggaaagagtcagcattccactccttcaagaggaagataccctggaaagttctacagggtttctcagtcagcactcaatcctcaccagtcgcctgacttcaagagaagccccagggacctccaccaacccaacaccataccagggatgcctttgcaccctgagactgactcaagagccagtgaagaggacagcaaagtcagcgaagggggctggacaaaagtggaataccggaaaaagccccacaggccatctcccgccaaaaccaataaagagagagccagaggggaccaccgtggatggagaaacttttgatgaattgaactacatagcttttctaagcaggttaaaaaaaaaaaaaaaaagaaatgtaatggtttttgataatatgatcccttcagattgaattaacgaaaagacaacacttccagtttttggattgggaaataccttctaattgagactatagccaaaccagggccaaaattatggatattggtcacccagtgatcataactaggcttgaaaatcactacacatattttctgccttgagtgaacatttttagaggaaaggttatgccatctttttaccctaaccactgatattctggttagcagggccaggacaaggggaaggaaaatgaggtcaacaaaaaaatcaaatttttaggaaaagataagatgaatgttactgatttttccttttggctgaggctgcaatatggcctggcaaggcactgttactgatcttgtctttaacattttgatattttgttcatcataatttttgcatttatttttttaaatattgcattaaaatatcatttagcttgattatcgagttttttggtttgaggttttttgttgcttcttttttcttttctttctttccccctcttttttttggatgtccccttaaattttgtgcccaaggcaggtacctcactcatctcatccttggctcagccctgctggttagtatttagtatttattttagtaagatatttgtgtctgtatgatggtcagagttgaactgatctggcttgtcatttttcagtaataaaaaaagttactgaatttaatgttgaatatgatgcatatctcattcattacgatttatcagaaaccaaagatttaaattgcctagatttgtggttctttctcttcctaagttcccagcgactgctttcaaatactattttctaaatttcaccaaaggagcaaagaggataaaacaacactccataaaggcctcttgggatgtcagaaatctaaaatctaaaagaaaacagacacagagcaagacaataacatcacaagctaaaagccagagaaatttaaaattaccaacatccttgttggagtaagacagtaaatatcagccttgcagcaagacagctctgagcagctgtgggcaaagaggtaaaccagtgggggtgcaaggagactgtctgcagcttagggcagaaatggtgggatccaacttgtgaaatgcttcatgttttacaaaccaaaaagtcaggtagcaacaaacttattgtatgtcaaatcaataaatgttactttcaataaaaaa

SEQ ID NO: 442958 - DNA, 1369 bp, Homo sapiens
ctagaggatccccgatgagtaaatcttgggatcacgtgttgggaagctgatgcaagaaacggccatcattcaagcaaatcatttcaatcctggagtccatgtcaaatgacacgagccttcctgacaagtgtaactcattcctacacaacaaggcggagtggaggtgcgaaattgaggcaactcttgagaggctaaagaaactagagcgtgatctcagctttaaggagcaggagcttaaagaacgagaaagacgtttaaagatgtgggagcaaaagctgacagagcagtccaacaccccgcttctcttgcctcttgctgcaagaatgtctgaggagtcttactttgaatctaaaacagaggagtcaaacagtgcagagatgtcatgtcagatcacagcaacaagtaacggggagggccatggcatgaacccaagtctgcaggccatgatgctgatgggctttggggatatcttctcaatgaacaaagcaggagctgtgatgcattctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatgaaagcagaaagcaaagtaataaaatcacaaatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagtatatttatgaatcagcaaatgtggtgcctgattatagaaatttgtgatcctatatacaatataggacttttaaagttgtgacattctggctttttcttttaatgaatactttttagtttgtatttgactttatttcctttattcaaatcatttttaaaaacttacattttgaacaaacactcttaactcctaattgttctttgacacgtagtaattctgtgacatactttttttttcttatagcaatacactgtaatatcagaaatggttggcctgagcaacctagtaagacctcgtctctactaataattaaaaaactagctggcatggtagcacacacctgtagtcccagatacttgggaggccaaggcaggaggattgcttgagacctagcaatcagtcagggctgcagtgagccatgatggcaccactgcactctagcctgggcaagagaacaagatcctgtctcaaaaaacaaaaaaa

SEQ ID NO: 442959 - DNA, 690 bp, Homo sapiens
atctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 442960 - DNA, 783 bp, Homo sapiens
attatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 442961 - DNA, 1422 bp, Homo sapiens
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgt

SEQ ID NO: 442962 - DNA, 3031 bp, Homo sapiens
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttttttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggagagaagcacagtccctgccaggttgcctgaactaaagatgccatggagcaggagtgtcttggtgcattgttccccgcttaggagtacctttaaaaagggggtgaaataaatttggcttaataattgta

SEQ ID NO: 442963 - DNA, 2231 bp, Homo sapiens
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagaagtgagcctgggtcagtcaaaaacagaatttgggcatttgagtgataacagacaacctaaggacaatgagcactttgcagatctctacaattaaaagttgcctctttgaggcaggaggagagaagcacagtccctgccaggttgcctgaactaaagatgccatggagcaggagtgtcttggtgcattgttccccgcttaggagtacctttaaaaagggggtgaaataaatttggcttaataattgta

SEQ ID NO: 442964 - DNA, 1750 bp, Homo sapiens
  misc_feature (1715)..(1715): n is a, c, g, or t
  misc_feature (1733)..(1733): n is a, c, g, or t
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctcccgtgtttaagccacttgataaatacccgcgaggagggattanataagctaccgggttatncatcgggttttttcaat

SEQ ID NO: 442965 - DNA, 2899 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagcatagcttgtgtgggacactggagccgttgtgatggcagcagaagtgttttccccttaaagccaagcccattaattttgatggaacagcaggacagctggcacggcggacgacccaccccttatcccctgggagtgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442966 - DNA, 2703 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagacatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442967 - DNA, 1393 bp, Homo sapiens
caggctatctactggccagtggaatagtgcagtaaagttcatacagagaccaggagtcttagaaaactgacctagagcaggagagacaggtcacatattggtaggagtaatgtgtcatgtttcaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagcatagcttgtgtgggacactggagccgttgtgatggcagcagaagtgttttccccttaaagccaagcccattaattttgatggaacagcaggacgtacagggcatgtctgaagggcaggacagctggcacggcggacgacccaccccttatcccctgggagtgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442968 - DNA, 952 bp, Homo sapiens
ctcaactggtataatgcaaatattccaaaatctgaaaaaatgggaaacacttctggccccaagcgttttggataagggatactcaatccgaagtgccatgaaaacaaaagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442969 - DNA, 1346 bp, Homo sapiens
caggctatctactggccagtggaatagtgcagtaaagttcatacagagaccaggagtcttagaaaactgacctagagcaggagagacaggtcacatattggtaggagtaatgtgtcatgtttcaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagcatagcttgtgtgggacactggagccgttgtgatggcagcagaagtgttttccccttaaagccaagcccattaattttgatggaacagcaggacgtacagggcatgtctgaagggcaggacagctggcacggcggacgacccaccccttatcccctgggagtgcttacttttctggtgcagaaagattgttgggaacagacaggaaccaatgtgggaattcaacttcaagttcaaaaaacagtcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442970 - DNA, 1902 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagtatagcttgtgtggacacatggagccgttgtgatgcagccaggtgataagggatctgtag

SEQ ID NO: 442971 - DNA, 1723 bp, Homo sapiens
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442972 - DNA, 2762 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442973 - DNA, 3653 bp, Homo sapiens
  misc_feature (3045)..(3045): n is a, c, g, or t
agcgcgagagttagcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttttttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggagagaagcacagtccctgccaggttgcctgaactaaagatgccatggagcaggagtgtcttggtgcattgttccccgcttaggagtacctttaaaaagggggtgaaataaatttggcttaataattgtaaaaaaaaaaaaaanaaaaaaaaaaaaaaaaaaaaggggggggggggcaaagaggatttcccgggggggggccccaagcgctttacaggaggtatacccacgggcttatgtgtgggaacaagcggggggcccacatattaggggaggaggcgaatatatataaaggcacaagggagcacgggggcgcgggcggttataaaacacgcggtggtggaggtggggaaaacacgggggcaaaggtgggggaaattcttggggagaggggagacccttaacattttcggggggggggggggagcattatgtggggaggaaaaaattacctcataagagagagagatttaaaaagggtccatagagggggaacatttttaacaattttaaaaggtggtatataatggggtgtgtgtaaaacaataacgaggggagaatatatgagcatagagagcggggtacgtagagaaaatgtataggaggcgaacaaggggagagcataaatgagagtattatatggagaaatatttatttatacacgccagggagagcctactcgtcgcaacaaatcccacaagaacaaagaagaggacagaaaagagaaaaagaaaaaaacaacgaagaacagc

SEQ ID NO: 442974 - DNA, 1604 bp, Homo sapiens
ctgcagcgaggaggaggtgttggcggggaagacgctgacgagagaaggcctcttccttgagggttggtgctgtgttgcagtgtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442975 - DNA, 2742 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaaaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442976 - DNA, 1366 bp, Homo sapiens
caggctatctactggccagtggaatagtgcagtaaagttcatacagagaccaggagtcttagaaaactgacctagagcaggagagacaggtcacatattggtaggagtaatgtgtcatgtttcaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagcatagcttgtgtgggacactggagccgttgtgatggcagcagaagtgttttccccttaaagccaagcccattaattttgatggaacagcaggacagctggcacggcggacgacccaccccttatcccctgggagtgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatctta

SEQ ID NO: 442977 - DNA, 2598 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatagcatagcttgtgtgggacactggagccgttgtgatggcagcagaagtgttttccccttaaagccaagcccattaattttgatggaacagcaggacagctggcacggcggacgacccaccccttatcccctgggagtgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgt

SEQ ID NO: 442978 - DNA, 2181 bp, Homo sapiens
  misc_feature (34)..(34): n is a, c, g, or t
gatattataagctgctttatttttccacgaatcntgacgtctctgcaatgcacatgtgtgaaaatctgctactgaaacatagagcaagcaaacactggcaggtgggtcaaaacgctactggtagcaggaggaacgactaaagcaaagtattaccataaggttaaaacatatggcctgacaaatgcctgccagggacactacacataaggaatgtcttcagtgtcccttcgtggggccctgcagccacccctgaattcccttggacccctaggatagaaggggtcctgtaaatttctttgcatccacaaaaacgcccccaatttctgtttgctttttctccttttatcctccaccctagccatgttgtcaaattctcttatcatgtcctcattgctgaaattcatatcatgtatggcttccttatattgcttgaggtactgagccagccccttgttggtttttcttttggctttcctgggtatatcatcctcagctgggcgctttcctgcagcccttgtttcactttctggctctccctcactctctggctctctttcactgtctggctctccttcaccctctgcccttccccctctctctggctttccctctgtctttgatcctccctgcatctctgactttcccttcctctctgactttccttctccttttgcctttcccgcactctctggcttttctttatcctttaacggttcctcaactctcttgcccgtgttttctgtgtttccctcgttttctaacttcttgtcttccagaatacaagctacttctggctttccctcgtgcggtggctgttcttcattgtctatctttccttgattcgaaggcattccttcattttcattgaagagtttttccatgtcgagatttcccctccttttcctttcctgcggggattctggacaggttgctcttccttttcaggcctctcagagcgctgggaacaacagacgcgcagacctgcggggacccaggacaggcctgtgcctcctgcggctcgctgaagcccgctcgctgctcccccgccgctcgtgccgaattcggcacgagcgccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggtgcgaccacagagagctcactcttttatctgtgtggctgatttcattactgtttgtgatttggagctactcactggatggtgacctcttttcactttctctactccatgtctgggcatgacccagctttggactccttgagcccctctctaatttaaatttgatattattaattatccaggtaattgtcttccgtgtggttgcctccttccccactccagtatccactttcagcaaaacgtcttgcttcaagtcccagatagaagagtctttgacttttcttcagaggcttattttagctagaatgtttaaagctacagatgcctatctgctcatctttccagctggattaggtgttgcttagatttgctagttgtctttaagtattacacagtttttgtatttatgcagccttatgtatagttgtagtggtgaggagtaggcaaattatatgattagtaaaagggctagttttgatgctaggtatggaagtgtagtgacaattgtaaactgtcaggctgtg

SEQ ID NO: 442979 - DNA, 4057 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442980 - DNA, 6829 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442981 - DNA, 7002 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacagcggcatcctgggaggcccgggagccctggctggcctgtggggtcctgcctggacacggaaggtggcctggagctgggagcgaggtccccctgcctcgttatcctccaggcagatgctgtggcacaccctgtggtgctgggaattgtgtgcccgcgtctgaatgggcaagacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442982 - DNA, 6711 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442983 - DNA, 5602 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggtcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442984 - DNA, 3711 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggcctcctcagtgagcaagcccggcccccgctgccgcttctctccaaaccaagtccctgacccgtggagaactctggggcgtgagctggggctcccccagcatggagaatccaaagctgacaaccagcgtcctggccaaggctgcccgaacactgcctctatgctgagcgtttcacacatgcagccagttcatcttcaccccaggctcagagaggtcttgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442985 - DNA, 4256 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442986 - DNA, 6452 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442987 - DNA, 6393 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442988 - DNA, 6183 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacgggggcgtgcgctagagggggaaaggggcccccggccacctgtccaccgtgtgggccgtgctgtgtccttatgtcattgtaatataaatacagatttttatatctca

SEQ ID NO: 442989 - DNA, 3107 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgaacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442990 - DNA, 4002 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctatgctgtctccacggacgactcagagcaagaagtggacatagagggcatggagtttggccctggtgagctggacagtgttggcagcagcagtgacgcggacgaccagctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctc

SEQ ID NO: 442991 - DNA, 3789 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctc

SEQ ID NO: 442992 - DNA, 317 bp, Homo sapiens
tggtgcttctgaggccgggttctcagccagagccctcctggcgtctgctgccccagggcccagacagcgccctccgcacttctgcccctctgcctagagcttctgcttccagaaaagggagaaatgggctggcaccctcagagtggcctgaccccatccccactctattctccctagaagtggacatagagggcatggagtttggccctggtgagctggacagtgttggcagcagcagtgacgcggacgaccactacagcctgcagagtggcaccggcggcgacagtggcttcgggccccactgccggcggctgggc

SEQ ID NO: 442993 - DNA, 266 bp, Homo sapiens
gatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagct

SEQ ID NO: 442994 - DNA, 6791 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442995 - DNA, 6890 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442996 - DNA, 6579 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442997 - DNA, 4195 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442998 - DNA, 3393 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgaggctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 442999 - DNA, 6307 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 443000 - DNA, 5568 bp, Homo sapiens
gtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgaggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgggcccccggccacctgtccaccgtgtgggccgtgctgtgtccttatgtcattgtaatataaatacagatttttatatctca

SEQ ID NO: 443001 - DNA, 1267 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctc

SEQ ID NO: 443002 - DNA, 1232 bp, Homo sapiens
tatcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagagaccgcatcccaggcactcagaggctgagccacatcctccactgctccccgcgggcactaacattgccgatgagacttggataaggaggggaccttgttctccatttcctcacttgatctttcacccgacaccacgtacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctc

SEQ ID NO: 443003 - DNA, 1350 bp, Homo sapiens
ggctggtctggaactgacctcaaatgatctgcccacctcagcctcccaaagtgttgggattaacaggtgtgagccaccacgcctgtcccagtatattgtttaacaagtttattttgggtgaaaaattctctttaatgggaagaagaggggctagaatgtgaattcatatctaaaaggacaaactgaaacaaaattcaataacaagattaagttttctgctattaagttgagctgtttcaagatagaataccggattaggttttgagttacagtagtccctccttatctgtggggtgtaagacctacagtggatgcctgaaagagccaagagtattgaagccttgttttttcctatacatacgcaactgtgataaagtttaatttataaattaggcacagtaagattaacagcaataatgagaacatttataactagtaagttttgtgaatgtggtctgaaaatactgtactgtgggaaagtgaagccatggtaagggaggattactgtatatcttcattttggtcttaagctttagaattatgggtaactaagaagccgtttgagatggttatattccatgactaaacttacctgggaattgtattatttacggggaaggcagttattttaaaaatgcttgtttaaggaagcagttgctgtatttgaattaagataactttcattagagattattagtgaaggttggccatctggttggctatgtgcttatagaattatagaagtaagctatttgttgacaattttagagttaaatttgacaatcttggttacctaccaaactttaaaatagaagtcaggatttctgttacccaaccatgggagctttggttgtctcatattcggtaagataattctctgttaaatagtggggtattagaacaaatggacttaagtaaaatcttcaatcatctttatgattgccctctattaattatattctgagtgggagagacctcccaaagccatgaaagaattgataaattggcctacataaaaataagaaatcttacattcagacttggggctttcacttatcataagatgaaaactaattttcagtgtttcctggtggtagatgacttaatatgctaaaacatttggggtaatctattttagatactacctatgtctgagacccagttccctacctctaccaaatgctagcagtatgaactttacctacttcacagtgttttaatggtcgaagtgttattttaaagtagtaactactgcataaaggatatcgaataagagtttctaaaactgaaatagagtaagtaagtttgtttatttaagaatttctaaataaattagatccaagaggcaga

SEQ ID NO: 443004 - DNA, 1542 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatatgt

SEQ ID NO: 443005 - DNA, 209 bp, Homo sapiens
taatggtttttttaatttcttgtgtatggtagcacagcaaacttgtaggaattaaaaaaaccattaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443006 - DNA, 1341 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattaaaagcagggagcagaatgttaaagaagctcctatttgaccccttgtattttcctagtgaaagcggaggtatttactggttaaaaatatatggaatgggcagggagcagtggctcacacctgaattc

SEQ ID NO: 443007 - DNA, 1350 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttgcataaaggatatcgaataagagtttctaaaactgaaatagagtaagtaagtttgtttatttaagaatttctaaataaattagatccaagaggcaga

SEQ ID NO: 443008 - DNA, 1154 bp, Homo sapiens
gtagctgattacggatgctttgaatcgacggtttctcagcgataacgttttcagcggccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443009 - DNA, 1753 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtacagttagattttacagcttctgatgttgaatgttcctaaatatttaacctggttttctttaatttcttgtgtattggtagcacagcagacttggacacagatgcagactactgcatcgcgctcagacacgtgcgctggctccgtccacagtcgactacgatcccagagcagtaaggccccagatacttgaccattgtcagcaaggaggtcattgccatggactaggttcacacagcaagttcggggagcctttcatatcatctccttggaatgatgactgaatcagaaggacagaagcactccaccgaaacgcgaaacatggcactacaataccaacaacgcaaacacaccacacaacacacgagcgcgcccaaaataacagggaaagggaacaccccaagactagtgaacacataccaccaacgagctagacaccgaaagaacaggactcaatatggactgcaccctgacccctggaagtcaacaggggcggatgcagcgcatgcatcgccaagacaaacaacggcacagggcaggacctcgcaatgccgtaaccaagaatcaaagagagaataaatacatcacaagcgccaactcgcgcctccaacgaagcaaaatgaagcagtag

SEQ ID NO: 443010 - DNA, 1241 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443011 - DNA, 1186 bp, Homo sapiens
gcggccgcccttgggaggacgccctcgggaggaggggggcgcgggcagggcgggagcggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443012 - DNA, 1071 bp, Homo sapiens
gtagctgattacggatgctttgaatcgacggtttctcagcgataacgttttcagcggccccgtgagggaagcgtctccgttgggtccggccgctctgcgggactctgaggaaaagctcgcaccagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443013 - DNA, 1799 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaagggtacagtgtcatcttttttaaagccgtggataagactaggtataggtaataactgtagaaaacctgggaaatttagttaatcttgtattaatggttgtcagctatgttttgaaaaggcctaatgaaaattgtacacttcaacacaaggtaattgaaaccttccttttgactgaaaccagtgtttgtagcactagtatattcctgcagacagacttgtagttacttgtagttattgtatagtctgtatagtctgttatttttttttttaagcagagagtcaaagaaattgttttatgtagatatatataaaatgtgaaggtacaggagggactatggcactgtgtgtgatgtaaaagggtattggtagtgaaagtactgatactgctgtatcgcaacccttgtcattttacgtcattaacttgttaaagcctagtgggataagtgctctaaaaacttagactggttacctttttagacagttattagggttattggtcaatcatcttagagttgtttacaactaagtggtttttcacagttgagtaatgataccggatgctttatttttttgacaatatttcaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443014 - DNA, 1288 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccgtaagtttaaaataacccaaattgctccttggatttttccttcagtttattaaactctgttgcttcctttcagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443015 - DNA, 1166 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443016 - DNA, 1574 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaaggtgaggcaggagagggacggagctcagggggtgcaggtgtggttttcggctaggagggccttaggcaggtagtaggcaactcatgagcttcaactttgccaccccagtgactcacctgaatatcttaagagttccaggcagacgattttaggtttttacttatataagacttcgaaagcaaaatgctgttaagggaaaatgtggtccttaaagatgatcttgtcgtctttggatgtttataggtaacaattttgctgtatttttggctcttattttatgtccacagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccgtaagtttaaaataacccaaattgctccttggatttttccttcagtttattaaactctgttgcttcctttcagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443017 - DNA, 1148 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443018 - DNA, 699 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaagccgtcgattcgagagatccttg

SEQ ID NO: 443019 - DNA, 1283 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccataaccaatactaccaatcaatactcatcattaataatcataatggctatagcaataaaactaggaataagccccctttcacttctgagtcccagaagttacccaaggcacccctctgacatccggctgcttcttctcacattgacaaaaactaggcgcccaatctcaaatcatattaccgaatcttcttccctcactaaacgtaagcctttctcctcaattctcttcaatcttattccatcattagcagccgttgaggtgggactaaacaaaaccaaggtagccaaatcttagaaaatcctcaaataccccattggatgaatataggcagtcctacttattcctcttttaactaataactctttattaagaaaaaaaaaaagacaaacaacaacagaaaacaaaagcgggcgcgctatttgtggggggagaacaagagatatagaggcgaagagcgatagttttcaacaacactttttagagagagaatagcgggacacctatagggatactataagggagacgagcataagcagatctatgataagttgatgaagagaagaaagaggataaagaggagagatgagtaacgaagagatgaaacgaaagacagatgagaaacaagagaatgatcagcatgaatgatgac

SEQ ID NO: 443020 - DNA, 585 bp, Homo sapiens
  misc_feature (133)..(133): n is a, c, g, or t
aggctgggtaaatttattaagggggggaggtctgtttggccccatggttctgccgggctgtacaggaagcctggtgcccggcatctattccagcttctggtgaggccctcaggctgtgtcccactcatggtangagggtgaaggagagctggcatgtgcagagatcacatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443021 - DNA, 573 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggttcgtggacctgcctttccccattccctcagagcctctactcggtctcggcgcagtggctctcggggtctgacccggcgagcggcatttggggtgcgggccggcgagggctgggtctgtggagggccggcgggcagtcggaggaggcggaaactgcccctgaccgggcccggttctgggagttttcaatgtcggtcacgaggtgcttagcggttaagtgaggctcgcgacgtgggagctgggggacatttctgtcaggaaaggcgttttgagggcgcttgcggagtcaccggactcggtgaagggcgggcggcggcgtctcgggccccgggagccacttgctgggctgagccgcggccgc

SEQ ID NO: 443022 - DNA, 1215 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443023 - DNA, 1241 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattaacaaacaaaaaaacaaaaaaaagggg

SEQ ID NO: 443024 - DNA, 1194 bp, Homo sapiens
  misc_feature (1171)..(1171): n is a, c, g, or t
  misc_feature (1179)..(1179): n is a, c, g, or t
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttagggggggcagnctaaaaanggacaagccgattga

SEQ ID NO: 443025 - DNA, 1185 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactgccataggaacagatccagagcaatgcatttcaattgctttgaatgagatggctaagctccattacataccaccatctaaagaagatacctcattgatggagcttttctacacataatagagggctgtcttgcattggttcacaatgacctgttg

SEQ ID NO: 443026 - DNA, 1185 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443027 - DNA, 1472 bp, Homo sapiens
gcggccgcccttgggaggacgccctcgggaggaggggggcgcgggcagggcgggagcggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaaggtgaggcaggagagggacggagctcagggggtgcaggtgtggttttcggctaggagggccttaggcaggtagtaggcaactcatgagcttcaactttgccaccccagtgactcacctgaatatcttaagagttccaggcagacgattttaggtttttacttatataagacttcgaaagcaaaatgctgttaagggaaaatgtggtccttaaagatgatcttgtcgtctttggatgtttataggtaacaattttgctgtatttttggctcttattttatgtccacagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443028 - DNA, 959 bp, Homo sapiens
  misc_feature (850)..(850): n is a, c, g, or t
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaaggagggaaggaaggaaggagagaaagaaaagaaaggaaggaagaaagaaaganagaaaagaaagaaagagaattttcacagatttagttccaagcaacagatgctacctcaggggcagaaagggaatttattgagaggatttggggtcactcacagaatccc

SEQ ID NO: 443029 - DNA, 1167 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 443030 - DNA, 814 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggagtcgacgcggccgcggtcgacgcggccgcgaattta

SEQ ID NO: 443031 - DNA, 1494 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaagggtacagtgtcatcttttttaaagccgtggataagactaggtataggtaataactgtagaaaacctgggaaatttagttaatcttgtattaatggttgtcagctatgttttgaaaaggcctaatgaaaattgtacacttcaacacaaggtaattgaaaccttccttttgactgaaaccagtgtttgtagcactagtatattcctgcagacagacttgtagttacttgtagttattgtatagtctgtatagtctgttatttttttttttaagcagagagtcaaagaaattgttttatgtagatatatataaaatgtgaaggtacaggagggactatggcactgtgtgtgatgtaaaagggtattggtagtgaaagtactgatactgctgtatcgcaacccttgtcattttacgtcattaacttgttaaagcctagtgggataagtgctctaaaaacttagactggttacctttttagacagttattagggttattggtcaatcatcttagagttgtttacaactaagtggtttttcacagttgagtaatgataccggatgctttatttttttgacaatatttcaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcagcctctggagttgatctgggtcagattcc

SEQ ID NO: 443032 - DNA, 750 bp, Homo sapiens
caatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgaaaaaaaaaaaaaaaaaaaaaacagaagaacacagtgtgtgggggcgcggccggggcccccgcgagaagagagccttcgagaaaacaatgggaggtggggcagagggcacacgtaaggcgaacagtaaacagggggcaaagagggtgtaccctagcgagaaaccggggacaatacacaagggcaggggactctccccggatagaaaaaagacccgggagggcaaccgggagggttcgggagaaagagcccgaggggagcccgagggacacaaacgggagaacgccaaacaggggagtccaagcggaacacaggagacaaatgtgacgcgg

SEQ ID NO: 443033 - DNA, 597 bp, Homo sapiens
gagttcggcacgatgctagatgggttaaggcgcagactacagagcagtacctcctcactgcaggtagtctgcgccttaaccctctgcagggagactgactgtagcaccaagctacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443034 - DNA, 766 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443035 - DNA, 770 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443036 - DNA, 772 bp, Homo sapiens
tatcggcttaggttagcgaggcccgcgcggttaatcggccgaggcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443037 - DNA, 791 bp, Homo sapiens
  misc_feature (20)..(20): n is a, c, g, or t
  misc_feature (22)..(22): n is a, c, g, or t
  misc_feature (780)..(780): n is a, c, g, or t
  misc_feature (785)..(785): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaaaaaccggnttttngggggg

SEQ ID NO: 443038 - DNA, 827 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataataccattgccacaacaagagagaaaaaaaaatttgtgggccacaggcctcgagaaag

SEQ ID NO: 443039 - DNA, 784 bp, Homo sapiens
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443040 - DNA, 546 bp, Homo sapiens
gtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgt

SEQ ID NO: 443041 - DNA, 737 bp, Homo sapiens
ggagaaaagagagagagagagaaagcaagagtacgagccagacgcagaggagctacggaaaaaggccgacaaacgggcagagcccttggagccgcgtctccttagagctgtttgcagacaaggtcccaaagacagcaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443042 - DNA, 900 bp, Homo sapiens
  misc_feature (900)..(900): n is a, c, g, or t
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataactaatatccaaaagaaacaaaaaaaaaattggggggctctgcgcgagaagttaaccatctgtgggcgggcgaggatgagcaaggatagtcccaagcacgcgactgttgtccccacn

SEQ ID NO: 443043 - DNA, 1083 bp, Homo sapiens
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataattacatgtcaacaaaaaagggggcggcaaatatcctgaggccatttcctaccgttttgtaaaggccaaaggcgtaaaaagacggcgtaacggggaaagctggtctggaccctgtggagaaccaaagcggaaatttttacctg

SEQ ID NO: 443044 - DNA, 941 bp, Homo sapiens
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443045 - DNA, 785 bp, Homo sapiens
aaaagtcatacctgtggtcaggctctccttagggactgaaagttgtagcactgtcccgaacacagattaaaatgctggtgctctgcgctctgcacagataagataaggtcttcctggtacctgctttcacagaataattccagagatttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcccttaatgcccggtcaggtctggcatgaactaacctcatccattacccacagcaacagcggacacccaacaaaaaagcctgcagtctccgggcgcatccacgggcgcgcagcgccctacgggcgacattacaggtggcaccttacagataacacagtgagccactc

SEQ ID NO: 443046 - DNA, 2298 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443047 - DNA, 2259 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443048 - DNA, 2249 bp, Homo sapiens
caaacaattaggctagtacgaggccggggttgaccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443049 - DNA, 2255 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443050 - DNA, 2261 bp, Homo sapiens
tatcggcttaggttagcgaggcccgcgcggttaatcggccgaggcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443051 - DNA, 2495 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcccacacacacacgaaaaaaaaaatttttgcgggccgcccagaaattttaaccctgtttggggccgccctatttatgaactgtccagtcgcaagaaaccgctaaagggggtcccaaaaacgggccggtcgaacccaggttcgctcgtctcagccctcccccgccccgccccgccccacaacacagcaagcccaagaca

SEQ ID NO: 443052 - DNA, 809 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443053 - DNA, 1569 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttcttgttgaaaataaaattaaccccgggaaaaatgaaagagggggtgaataccacagaaaagtgggggccccgccccctgggggtccaagcgaatcatggcacaaaagtccctggaataccgaaaaaacggggttggccccaagcccacgcacactgggaccaccaacgacgggatcacaatgagcaaccggtcaaacaaga

SEQ ID NO: 443054 - DNA, 2037 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttctttttttttttctccccgggaatgtgcgaggtggcgtgtgactcctcgagcgctcaagcgtggcgagcctctccgcctctcctggggtttcgaggtgttgattctagtgtgccttcgagccctccgtgaagttagcgtgggaataacgggcgtgtgtgcccaccatgtgccacagtgctttaatgtttgtgtggtattttttaggttttataagatgtgggggttccgatctacattttgtgacccagggggtgtggctcctcaaaactgtctgtgtgacctctcaggctgtgatgtgccgcctgtgcctgtgtgcgcctctccgcaaagcggtgctgtgaggatttcacaggatgtgtgtgaggccaccggccaccctcacctgcttttctctggtacagcagaacgctaagcgcttagaaccactggtggagatggtcctggaggggagggcatatcggggcttaaaggcgctggtagggctcaagtgtttgtaccttcctcactttgttgggggggactccctattgtggatgtctaaaagagcccgggtcctgggggcgcaccggccaggtcccctgcagaggggtttagggcggcagctccctgccgggggggagggacgggtgggcatttagaggctttcccagcttggatgggggcttgggttttggacttc

SEQ ID NO: 443055 - DNA, 1235 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcaggagaactgcttgaaaccagaaagcacaatgagccaagatcgtgccactgcactccagcctgggagacagaatatgagagactctgtcccaaaaaaaaaaaaggtccggctgtggtgtctcatacctgtaatcccggcacttcgggaggccaaggcctgaggaccttgagccaaggagtttgagaccagcctgggcaatataggggga

SEQ ID NO: 443056 - DNA, 848 bp, Homo sapiens
  misc_feature (65)..(65): n is a, c, g, or t
  misc_feature (67)..(67): n is a, c, g, or t
  misc_feature (828)..(828): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacatgtcaaaaaaaaacatnatacatattaaaaaaataaa

SEQ ID NO: 443057 - DNA, 834 bp, Homo sapiens
  misc_feature (65)..(65): n is a, c, g, or t
  misc_feature (67)..(67): n is a, c, g, or t
  misc_feature (823)..(823): n is a, c, g, or t
  misc_feature (828)..(828): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaaaaaccggnttttngggggg

SEQ ID NO: 443058 - DNA, 925 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaacaaaaaaaacaacaaacacacacaaacactacaaacatacaacacacatcctcactaactacacacacacatacatacactctatatcataataccaacacattataaaataag

SEQ ID NO: 443059 - DNA, 1021 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaaaaaagaaaaacgtcagagggaaccccttggaggtgtttggacgccgttctgggaaagctcttctgggtctgacccgagaggaatcacccctccctagaagccgcttaccacccgggtaattggagaggacgcctcaaaacttcgatttggtatgcttaaacagaggtatccaaaagcgctaacgggctaaaggtcacctctgatgg

SEQ ID NO: 443060 - DNA, 2201 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcaggctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443061 - DNA, 2412 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443062 - DNA, 2322 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443063 - DNA, 3083 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcggggaggaggccgggacggcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgggctccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443064 - DNA, 2434 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcaggtgtttaatttttttttaaacaaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443065 - DNA, 3122 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccaaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaagctacctttctcgtcttggttcatgacacatggaggctgcttgtttgtggttgccagtcatagtgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443066 - DNA, 2239 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagacatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443067 - DNA, 1993 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443068 - DNA, 923 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443069 - DNA, 1065 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataattacatgtcaacaaaaaagggggcggcaaatatcctgaggccatttcctaccgttttgtaaaggccaaaggcgtaaaaagacggcgtaacggggaaagctggtctggaccctgtggagaaccaaagcggaaatttttacctg

SEQ ID NO: 443070 - DNA, 938 bp, Homo sapiens
  misc_feature (20)..(20): n is a, c, g, or t
  misc_feature (22)..(22): n is a, c, g, or t
  misc_feature (927)..(927): n is a, c, g, or t
  misc_feature (932)..(932): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagtgatgggagttattttgatttgaataaataattcaaaaaaaaaaaaccggnttttngggggg

SEQ ID NO: 443071 - DNA, 1633 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccaaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaagctacctttctcgtcttggttcatgacacatggaggctgcttgtttgtggttgccagtcatagtgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443072 - DNA, 1043 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443073 - DNA, 504 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgagctgtttgcagacaaggtcccaaagacagcaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataa

SEQ ID NO: 443074 - DNA, 1851 bp, Homo sapiens
  misc_feature (20)..(20): n is a, c, g, or t
  misc_feature (22)..(22): n is a, c, g, or t
ggggggtaaactacggctangnagcgaggctgggtggtgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcggggaggaggccgggacggcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgggctccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttgggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccgtcctggccaacatggtgaaaccccacctctattaaaaatacaaaaattagctgggcgtggtggcgcttgcctgtaatctcagctactctagaggctgaggcaggagaatcgcttgaaccccggaggcggaggctgcagtgagccgagatcgtgccactgcactccagcctggtgacagtgagactcttgtctc

SEQ ID NO: 443075 - DNA, 999 bp, Homo sapiens
  misc_feature (65)..(65): n is a, c, g, or t
  misc_feature (67)..(67): n is a, c, g, or t
  misc_feature (601)..(601): n is a, c, g, or t
gagagagagagagagagagagagagagagagagagagagagagagagagagagagagagagagananagagagagagagagcccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgactatcacacgccataaatggccactgggtggcaagtccaatctatggggggagaaaatttcggaaagaattgaagaaactttcaattccttaaaaggccattaaccggggttccttgggccattcttgtgtcccattggggcaaattggcttgggaaaccacaaaaccaaattggtttccacagtttattcactctggcacttgccaaagaactggacgtcggttggagatggcgcacagcattgtaggtggtattgggcaacaggtgcaacagcaagcgcatggaactatgtgtngcgagcgaccattgtgacgcgctatatgggttaccacggaaattggcaaggacgcagacaatgaaagattcaccgatttgcttgacttgtgagacgaagctacgaattaagtttctgacatatgtgtcaactatctgtaaaccaaccagaatcgattgcctatctgttagtctacaggcaagagcgaccaccttcgcagcacacatgttggctacgcaaggtatctcatcagagatacttttgtaggctactcgactagcaagttatcacctatatgaggttccaatgtatttgcactatgattccactaccacatagccttagccttgggattggcaggagtttctaagtcttatagatgtatgacaatgaaaaaactagattaaccaacagaaaaa

SEQ ID NO: 443076 - DNA, 811 bp, Homo sapiens
ttttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacaaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaa

SEQ ID NO: 443077 - DNA, 619 bp, Homo sapiens
ctcctctctctcttgtctccctctctctcttttgctctgccactactgacgtgctcggcctggcaagcgttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaaaaaagaaaaacgtcagagggaaccccttggaggtgtttggacgccgttctgggaaagctcttctgggtctgacccgagaggaatcacccctccctagaagccgcttaccacccgggtaattggagaggacgcctcaaaacttcgatttggtatgcttaaacagaggtatccaaaagcgctaacgggctaaaggtcacctctgatgg

SEQ ID NO: 443078 - DNA, 547 bp, Homo sapiens
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggactgaagatgaacgaagaggatgatgaggacgaggatgacgacgacgacgacagatcacgaagacgaccgcatgacgcacgaatgactgaaggacggacggcacgaagcaggcacgcacgaagagaccgacaaccgaacgcacccgcacacccgcccgccccgcgccactggcacccaacaaacgcactcacgacagccacaaccaagtggaaggcacaaaac

SEQ ID NO: 443079 - DNA, 815 bp, Homo sapiens
  misc_feature (807)..(807): n is a, c, g, or t
gaacgtggtataaaaggggcgggaggcaggctcgtgcccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataatgtcaaaaaagaaaaaaaatctncagcgctg

SEQ ID NO: 443080 - DNA, 2379 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatggtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctccaaggtaggcagaggcaggaaaagcaaggagccagaattaagaggttgggtcagtctgcagtgagttcatgcatttagaggtgttcttcaagatgactaatgtcaaaaattgagacatctgttgcggttcttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacagtctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttc

SEQ ID NO: 443081 - DNA, 2177 bp, Homo sapiens
  misc_feature (3)..(3): n is a, c, g, or t
  misc_feature (22)..(23): n is a, c, g, or t
aanagggtatcaacgcagagtnnccattacggccgggggttttccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtgactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccaaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaagctacctttctcgtcttggttcatgacacatggaggctgcttgtttgtggttgccagtcatagtgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataaaaaaaaaaaaaaaaaaaaaacaaaaaaaacaaaaaaaccaacaatacaaaaacatagaaagaacaatacaaatagtacataaacaaactacaaaatagaattcacaacaaaaacaaacaaaagccatcgaaaaaatacactaataacgaataaccacatacaaacataaaataaaaaatatagaggcgcccacaatttatctctaactatctacagcccaagcacaatcacaccacccacatatttctttatatcgaccacactcctatcagatatatttattctcatccaggccgcccctacatccgcagggaggagagaaccactcctcgtcgttgttgcaggactcctttctgtgggtcgatacgccggcccccatgctgcactgtacgtgatgcaacatgtgtgtgcggataacccgattgtagctgaggcgctcgatgattaaatatgacggaagagcgagggggcgtaggtgactgagctcggctgcggggacgacgggcagaggagcgacgagtaggagagagagaggcagtggagt

SEQ ID NO: 443082 - DNA, 919 bp, Homo sapiens
gcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443083 - DNA, 764 bp, Homo sapiens
agagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443084 - DNA, 1168 bp, Homo sapiens
tgagttgtgacttctcttttagctgtgcaagaatccgtgtctcttctttagcccatcttaatgctgaactacttggtttgtctaaatttcagagctgtgctcagtctttaatcccctacagcccatgtggtaatcagttaacgagagcctgtttggctacatgcttgagagtcagcaggcatacgggttaaggtcatctactctttgggggagttctgacaaatggaacagcttgttatgactttataagagggctttaaaattgcttctcaccatttaacgatagctcagaacctgtgcgtcaaccagtacagtttgtcctcagtaatgtcctcaggctgtttcaattttgcttatatgatttaggtttgggtcatagtctccttggatggagtcatttttttttttttttaatttcagcagcagtcctattgttctggaaccttctgggacattcctgaagagtcaggacaatttcagggcttcctcagggactcagattctaaatgagattccaaattctgtaggcccagccaacattgatctaaacctttgggaaatacccctaaacatatctatgcctcagggtttgaaaaacaatgaagtgttggactgtttcagacttctcagattctcactggtaggagtgactacctaggcaatttcatcttagctgcaaccctgaaacgaagctctatttatttttcctatgttgtcatggcatttggtctcacctaaggggaaatcaggatgcctgagttctgggcaggtgataatagttcctgttcttatctctctgcctctttcctcattcttttgggttaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443085 - DNA, 983 bp, Homo sapiens
tgagttgtgacttctcttttagctgtgcaagaatccgtgtctcttctttagcccatcttaatgctgaactacttggtttgtctaaatttcagagctgtgctcagtctttaatcccctacagcccatgtggtaatcagttaacgagagcctgtttggctacatgcttgagagtcagcaggcatacgggttaaggtcatctactctttgggggagttctgacaaatggaacagcttgttatgactttataagagggctttaaaattgcttctcaccatttaacgatagctcagaacctgtgcgtcaaccagtacagtttgtcctcagtaatgtcctcaggctgtttcaattttgcttatatgatttaggtttgggtcatagtctccttggatggagtcatttttttttttttttaatttcagcagcagtcctattgttctggaaccttctgggacattcctgaagagtcaggacaatttcagggcttcctcagggactcagattctaaatgagattccaaattctgtaggcccagccaacattgatctaaacctttgggaaatacccctaaacatatctatgcctcagggtttgaaaaacaatgaagtgttggactgtttcagacttctcagattctcactggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443086 - DNA, 823 bp, Homo sapiens
agagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaactgtcttgtgtttgaatattccacacacttttaaataaatatacagataccacag

SEQ ID NO: 443087 - DNA, 499 bp, Homo sapiens
agatagaatcgagctggtaccccccgactagcccgacaggtgctctcttgacagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatgggggtgcgagatgtgaaagagtcagaggagaagggttgctggctcggagcgggccgttgttataaaccgtgagagaaagggctgttgtcgggctagtcgggg

SEQ ID NO: 443088 - DNA, 591 bp, Homo sapiens
agagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggtatgtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattg

SEQ ID NO: 443089 - DNA, 217 bp, Homo sapiens
tgccttacgacggctaaaagtatggtttgtcagataactagaaagaaaagcctcagagtggaactctggccagtataaaagtctacgaatgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443090 - DNA, 953 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443091 - DNA, 899 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataatctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443092 - DNA, 1678 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaaaaaaaaaaaaaaaaaaaaaaaaaaaaaaaaaaaaaaaaaaaaggggggggggggggggcgagaaaaatttaaaaaaaatggtgggggggggcgggaggcggcggaccgcgtgtagggtaactagacaacatggggcccaacacacggccgtccccagaggaaaacacccgcggaacaagaagatgaggccgggtggtggttttccccccaacaataaaaaaaacgccgcggggggcgagcaacccgaggggcttctttgggaaacaaccaaccgaaggggcgtcgacaggaggaacagacgactggccttcaaaacaggaggcgacccacacagagaacgccggcatttaacaatgacgcccacccgcacggggggagagaaaatgagcaaaacacaaaagaaaagacaaacaagcaaccaaggcagcgaggtgaaagtcgaagcataatttataaaaacaagaagcgagtatgagaagatacgcaaacagcaaaaaaccaaggaagacatcacgaacagcagttaacgatatacggatcagatcaagatccggaacgcgaaatgcgagaagaatactcactacggtaggagtataaagaacgtagatagtcagagagagaataatacgacaaataaaaagaagacaacaaaaacgataaataaagaatacataagaagagaagcggagaagaaaagaaagaaacagcatcgcattttatg

SEQ ID NO: 443093 - DNA, 1092 bp, Homo sapiens
  misc_feature (977)..(977): n is a, c, g, or t
  misc_feature (1008)..(1008): n is a, c, g, or t
  misc_feature (1033)..(1033): n is a, c, g, or t
  misc_feature (1060)..(1060): n is a, c, g, or t
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaaaaaaaaaaaaaaaaactcgngactagttctctctctcctcgtgccgaattnggcagggccaggactcagaggggancccaccatggtgctgtcttctgccganaagaccaacgtcaaggccgcctggggtaaggt

SEQ ID NO: 443094 - DNA, 712 bp, Homo sapiens
taatctgttctcacgaatctcagattgatgattcttcaatcaatcttctaaggtgagatcacagaacttcataaaatggatcccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443095 - DNA, 1060 bp, Homo sapiens
  misc_feature (913)..(913): n is a, c, g, or t
  misc_feature (961)..(961): n is a, c, g, or t
  misc_feature (972)..(972): n is a, c, g, or t
  misc_feature (975)..(976): n is a, c, g, or t
  misc_feature (986)..(986): n is a, c, g, or t
  misc_feature (990)..(990): n is a, c, g, or t
  misc_feature (993)..(993): n is a, c, g, or t
  misc_feature (995)..(995): n is a, c, g, or t
  misc_feature (1001)..(1002): n is a, c, g, or t
  misc_feature (1008)..(1010): n is a, c, g, or t
  misc_feature (1017)..(1017): n is a, c, g, or t
  misc_feature (1020)..(1020): n is a, c, g, or t
  misc_feature (1025)..(1025): n is a, c, g, or t
  misc_feature (1031)..(1031): n is a, c, g, or t
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattatgaggagccaantatcagtataaattatcaggaaaaaaaaaaaaaaaaaaatggggggcngcgaaatttanatnnggggggggcnggangangnaaggcnnaacggnnngggggtnccnaaacnggcggntgaaacagtggtggtaagggcacacgcgg

SEQ ID NO: 443096 - DNA, 968 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgtggagagagctctctccacactgggtataattgaatcacatagaagatatatgttcgcagagggacagatggatgacttggtgtgctttgaggaattgacag

SEQ ID NO: 443097 - DNA, 900 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcttaaaacaagaaagtttccccaccagtgaatgaaagtcttgtgactagtgctgaagcttattaatgctaagggcaggcccaaattatcaagctaataaaatatcattcagcaaca

SEQ ID NO: 443098 - DNA, 652 bp, Homo sapiens
ctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443099 - DNA, 550 bp, Homo sapiens
gtgctgtccctcctctgtgctgtcggacagcgcataggagggtggccgagggtggaagggactcagggaagtagacgtcggaaaatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443100 - DNA, 914 bp, Homo sapiens
agaacaggggtgggggtgggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443101 - DNA, 764 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtctactgtatgacaggacagtctctgcctagcaccatcatcacgtaggagctct

SEQ ID NO: 443102 - DNA, 554 bp, Homo sapiens
ggaaatgggtgaacgtgataaagacacaagtctcaggacccaattagagaagatatgagtaggcccatcactagaggtgctaatggagaaacctaagtcaaccagtgttggcatcgaattatgcaagtggaacatacatctgtagagcgaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443103 - DNA, 441 bp, Homo sapiens
tggtagtctcacggttcggtcgctctacgacggactctccaagattaaatggttgggacgatgtgcttgaggtgcatggcaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443104 - DNA, 780 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggtatgtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattg

SEQ ID NO: 443105 - DNA, 1893 bp, Homo sapiens
tgagttgtgacttctcttttagctgtgcaagaatccgtgtctcttctttagcccatcttaatgctgaactacttggtttgtctaaatttcagagctgtgctcagtctttaatcccctacagcccatgtggtaatcagttaacgagagcctgtttggctacatgcttgagagtcagcaggcatacgggttaaggtcatctactctttgggggagttctgacaaatggaacagcttgttatgactttataagagggctttaaaattgcttctcaccatttaacgatagctcagaacctgtgcgtcaaccagtacagtttgtcctcagtaatgtcctcaggctgtttcaattttgcttatatgatttaggtttgggtcatagtctccttggatggagtcatttttttttttttttaatttcagcagcagtcctattgttctggaaccttctgggacattcctgaagagtcaggacaatttcagggcttcctcagggactcagattctaaatgagattccaaattctgtaggcccagccaacattgatctaaacctttgggaaatacccctaaacatatctatgcctcagggtttgaaaaacaatgaagtgttggactgtttcagacttctcagattctcactggtaggagtgactacctaggcaatttcatcttagctgcaaccctgaaacgaagctctatttatttttcctatgttgtcatggcatttggtctcacctaaggggaaatcaggatgcctgagttctgggcaggtgataatagttcctgttcttatctctctgcctctttcctcattcttttgggttaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaaaaaaaaaaaaaaaaaaaaaaaaaaaaaaaaaaaaaaaaaaaaggggggggggggggggcgagaaaaatttaaaaaaaatggtgggggggggcgggaggcggcggaccgcgtgtagggtaactagacaacatggggcccaacacacggccgtccccagaggaaaacacccgcggaacaagaagatgaggccgggtggtggttttccccccaacaataaaaaaaacgccgcggggggcgagcaacccgaggggcttctttgggaaacaaccaaccgaaggggcgtcgacaggaggaacagacgactggccttcaaaacaggaggcgacccacacagagaacgccggcatttaacaatgacgcccacccgcacggggggagagaaaatgagcaaaacacaaaagaaaagacaaacaagcaaccaaggcagcgaggtgaaagtcgaagcataatttataaaaacaagaagcgagtatgagaagatacgcaaacagcaaaaaaccaaggaagacatcacgaacagcagttaacgatatacggatcagatcaagatccggaacgcgaaatgcgagaagaatactcactacggtaggagtataaagaacgtagatagtcagagagagaataatacgacaaataaaaagaagacaacaaaaacgataaataaagaatacataagaagagaagcggagaagaaaagaaagaaacagcatcgcattttatg

SEQ ID NO: 443106 - DNA, 1665 bp, Homo sapiens
agaacaggggtgggggtgggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctaccctgcctaaaccattttaggcacatgtgtgtccaaatgtgaagaaaaatgaggaggttgctagtgccttcctcccccatcacctgtttctatttgatagtcctctgtatcccatttattacattttttcatgcactgtcaagtttatcctccgtcccctaacttctctacaggatacccctttctggtttggttcatgacaatctgcagggaaagagctgccttcaaactcctttgcttatctcttccaacaccttggactcttgaccgattttaccatctcaggtttcagagccaggagagagccctgcctcatcctgagctgttcatccccatgggtattttctgcctttctattccctcttctatgattttctgggtttctcagggctacgacagggcgctggcctgggtccaatcaagccctacgaggaaacaatatagggacgcccatttgtcctaagagggtggaagaacagggtgaacaaataaggttgacagagctgtcacagataacactctggtttaaaaatattcaagtgtgagtaaacaggagctgagtgggcaagggctttggaaggacaagcaggaccagcagaacattccagattggatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443107 - DNA, 1012 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaactgtcttgtgtttgaatattccacacacttttaaataaatatacagataccacag

SEQ ID NO: 443108 - DNA, 1250 bp, Homo sapiens
gcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaaaaaaaaaaaaaaaaaaaaaaaatttttgggcggccgggcccgaaaaattcttctataacccattcggtttggggaccgggccgcggagtggggtatatgtaaccgttgggtccatatagcgtgtttccctaagaaaaacccggggctaagagaataagtgtgctgggttttctccccaatattaaaaaagcccggcggggaacccgagcgtttcgtaacaaatcccgaagggagttcgacgcaagtcggggttttataacagaagtcaaagggacgccatataatacgcccgggga

SEQ ID NO: 443109 - DNA, 974 bp, Homo sapiens
agaacaggggtgggggtgggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaaca

SEQ ID NO: 443110 - DNA, 1685 bp, Homo sapiens
gaaacaagcactggattccatatcccactgccaaaaccgcatggttcagattatcgctattgcagctttcatcataatacacacctttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagttta

SEQ ID NO: 443111 - DNA, 648 bp, Homo sapiens
  misc_feature (619)..(619): n is a, c, g, or t
gtgtgtgtgtgtgtgtgagagagagagacagagagagaaacagagagagtgtgtgttgcctaaatctcccgagagagagagagagagagaaagagagaaatggctaaatccccctagatcaaagtccttggaaccagatgtaccagcatcctatctaaacacaggcccctcctgactatcattgttttatcaccctttttccgtctacctttctcttcctcataaagcctagttttcctctgtttccctgccaaatggaagagttttccctaactacattcttctgcaggatgtgggggctcaaggttctgctgctacctgtggtgagctttgctctgtaccctgaggagatactggacacccactgggagctatggaagaagacccacaggaagcaatataacaacaaggtgcctggggtcctggagggggcatggcaggaaggctgagacctgagctctctcatcttagcttccagactcccttcttcaatccaaatgctttattccaagcaaatcagtccctcttccctaactcatgttaacatacggttttcattcctatgcttcaaatcatcctctggcgtcctaggattaatggcgttaaactataagccatntatctggcttttcacaaactttgggttgc

SEQ ID NO: 443112 - DNA, 622 bp, Homo sapiens
gtgtgtgtgtgtgtgtgagagagagagacagagagagaaacagagagagtgtgtgttgcctaaatctcccgagagagagagagagagagaaagagagaaatggctaaatccccctagatcaaagtccttggaaccagatgtaccagcatcctatctaaacacaggcccctcctgactatcattgttttatcaccctttttccgtctacctttctcttcctcataaagcctagttttcctctgtttccctgccaaatggaagagttttccctaactacattcttctgcaggatgtgggggctcaaggttctgctgctacctgtggtgagctttgctctgtaccctgaggagatactggacacccactgggagctatggaagaagacccacaggaagcaatataacaacaaggtgcctggggtcctggagggggcatggcaggaaggctgagacctgagctctctcatcttagcttccagactcccttcttcaatccaaatgctttattccaagcaaatcagtccctcttccctaactcatgttaacatacggttttcattcctatgcttatttctcttttgggaagagttctaagattaatgctgttaatctataagcaattt

SEQ ID NO: 443113 - DNA, 1843 bp, Homo sapiens
gcgcactcacagtcgcaacctttccccttcctgacttcccgctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443114 - DNA, 1699 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagttta

SEQ ID NO: 443115 - DNA, 1992 bp, Homo sapiens
gtgtgtgtgtgtgtgtgagagagagagacagagagagaaacagagagagtgtgtgttgcctaaatctcccgagagagagagagagagagaaagagagaaatggctaaatccccctagatcaaagtccttggaaccagatgtaccagcatcctatctaaacacaggcccctcctgactatcattgttttatcaccctttttccgtctacctttctcttcctcataaagcctagttttcctctgtttccctgccaaatggaagagttttccctaactacattcttctgcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443116 - DNA, 1789 bp, Homo sapiens
gcgcactcacagtcgcaacctttccccttcctgacttcccgctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443117 - DNA, 1869 bp, Homo sapiens
gtgtgtgtgtgtgtgtgagagagagagacagagagagaaacagagagagtgtgtgttgcctaaatctcccgagagagagagagagagagaaagagagaaatggctaaatccccctagatcaaagtccttggaaccagatgtaccagcatcctatctaaacacaggcccctcctgactatcattgttttatcaccctttttccgtctacctttctcttcctcataaagcctagttttcctctgtttccctgccaaatggaagagttttccctaactacattcttctgcaggatgtgggggctcaaggttctgctgctacctgtggtgagctttgctctgtaccctgaggagatactggacacccactgggagctatggaagaagacccacaggaagcaatataacaacaagaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443118 - DNA, 1877 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttactagatgctatttattaaactgtagacaggagataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443119 - DNA, 1483 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatgtataaagacggccatgtggtcagccatgcacgattttaaatgcgtccgtcaggacagtcaataatcagctatgtactcattggataaatagattgtgatcacatcgtgcccctgagcgtgttacttcctgggttgaacgagtacaaggtacgcgctagagcttcttctacatgagtaaattctcattggac

SEQ ID NO: 443120 - DNA, 729 bp, Homo sapiens
gcgcactcacagtcgcaacctttccccttcctgacttcccgctgacttccgcaatcccgatggaataaatctagcacccctgatggtgtgcccacactttgctgccgaaacgaagccagacaacagatttccatcagcaggtaacgtttgcaacttcctagatcttttagcttttcattcctgtcaattctctgagtattagggatgtagtgacttgaggatcacaataaacttttagcctctgcagatgaaaacagagatgcacttcttaggtcattccctggctaaataaaatctgcctggaaatctgtagaattccttgtatgatttatatatatacatacatgattgttagtaaaagcaaagtatatagggaatcatttccccatccttcaagagtggcctttctgcagtgttttctactttggccaacaaggatcaaaacggttaactccttagtgaggaggaggagagtggtatggggaggtagtagctcagtgcttcctgttcactgagacatctcaaagcccttaacactctagtttttaaatgtcctactggacattttgccagtttgcaaaattacatgtaaatggactataagcaattgtgtaagccatatgtcatgctgcaggctgcaaattgttcttaaaatggaggatttgtaattaagaaagccaatgcaagaaatgagtgaagctaactagagtaaacttatgaaaagctgtg

SEQ ID NO: 443121 - DNA, 1751 bp, Homo sapiens
gtcgtcgaggacccgtcgacgaagcgtagaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443122 - DNA, 1845 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443123 - DNA, 1889 bp, Homo sapiens
ggaagaagaaatgcataaggagaatgaggagatatacaatgtctcagaaaacaggaaacattgtcctattttcccttgtcctcttctgacaagatctgggaaagtaccagaatttaggcacgaaagagaagaacgcctcgaagaaatgatcaggaggcaaaacttagacggaaatctctcctttgtgatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443124 - DNA, 1790 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443125 - DNA, 1637 bp, Homo sapiens
gagggtaccaggatgcagcgcaagtagtgctacaggaaggaatataacaagcaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443126 - DNA, 918 bp, Homo sapiens
cccccacctgctcataaatcacgataatctgagcctatgcgctgatggcagctggtgatatcggaatcctttatcggtaccacgcactgttataattgcacaatagctggtgagcgatcagacgataccttggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattcattttgtgttggatactgtgttaggtgctggaggaaaaaagatgaatagaacatcttctatgtacttgatgcgctcacagtctggttgtagagactgtcacataaacatttcatcccaattc

SEQ ID NO: 443127 - DNA, 882 bp, Homo sapiens
agcggtcctcctcttacccaaattttccagccgatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagacaggtcccactcgggccactgtatcttcagggctttctcattcccctcgtaactgtgccgag

SEQ ID NO: 443128 - DNA, 555 bp, Homo sapiens
catggcactgagttggggccagaacatggtttgtggagagtgggtcagcactggggtggggcagaggcatatagctgggcccaaattatagtttctgcaattagccagcatcaggcagaatggaaatggggggaggtggctggctttgtggagctgcagccagaaggcaactttcagggcgagcagaaactcaaaagcaggaactgttcttttaccatcgcagaactaacatcacgctcctaacagcagcatccgttcagcgcctcggacagctcccaggaagccaacaacctggacagctatgaaaggacttttcactccacttttaaagtagtggcatccaccttggggataaaatgcagaccaggaagttacaacctacagccccccaggagctctcagttcctgacataagtaaaatcattcattcattcactcatggtacactctttgagagcctcttaatgggcagggctcacacttgcaggatgctccttgggtgtgcctgcatctacagtgggagggactaggtgcaggtgggtaatcctgctcgag

SEQ ID NO: 443129 - DNA, 591 bp, Homo sapiens
ggaacttgagcatccgtggatttttgtatccatagagagtcctggaaccattcctccacagataccatgggatgactgtagttggtcatcccaatgacagtggtaagtgcctatgaatttttccctatcccactttgtacccagatgttccagtgatcagttctggagtttgttaactcactgaatgtgtttcctctcctaggttaatagttactaatgttgctgcctgttgcttcctgctttatttaggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443130 - DNA, 1647 bp, Homo sapiens
tgttttctggcctgcactttcactgcctgtccctcccgcggtccccaacatgataaggctagcttacatttgtggcttctgtagttcttccttaagatgtttttcttttgacttttttaaagctttgatactctattccttttgttggatttcctaattgtagtacctttattcctatccataactatagtagggtgacttcaaaaaaagaccagtagttttttgtgttgaagccttgctgtttgaaaggtggggttttttggttttgcttttaaagtctgatgtgccgatgctgaccctcagatgatgagagcacttttaaaacaagacggcaggctggaatttgagttccatcttgagaatatccgagcaggtgtagatttcttctggggctcctggcccatgacctcagccctgtgtgcgcctgccctgtctctgtgagggctaccggctgggccttctgcagggcgtggacatggatggctgcctctgcggccacgtgctacacgcccacctccctgatgacagggacgtcctcacacgggtcttgcctgcttggaacctcatgggtccctcatgtctctgcagggaggatctgctctgtatccacaggggaaagtgttctggagcttctgtctcaacgataggaaagatccctgccccacccacaccccttttaggttttccaggccttgacacatggctttggccgatgtttgtgtgtatgttgcatttaaaagagtttgaaagtggtcatttacttttctttttaggggcccaagaccctggcatgttattgttttaatgtcaaaacccaactttagaaataaattagccaatcatattatttattagactgagaatagagacagggcagctggggagtgtggaagaagcttggttctcttcctgaacaactgcacagatgatagtaattggaatcgtgttgctggctcattttcattgtttttcaagtactgccaagtccaagaaaatgtatgaaaactaaattatatccccctacatcccatgtctgattgaatcctcctcatcggatggcggtctcctacatcctattaaaatattcaatcttgttttcttacttgaagagcctgtctgcaaagggcaaacttacagaacactcattccctgggagacgggtgtccagccgcactggaccatttacatattttactgtttgattgggtttcttccttctgttgtatttgtgagtaagagctgtggggtgcatttttaattacatggctgtgttttcaacagaagaaacagaatggggtattttccagcttctgcgttcctttttaaccttgaatagtgaaccagtgtgttaaccagtttgctgtgtttgtcttttaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443131 - DNA, 2118 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443132 - DNA, 381 bp, Homo sapiens
  misc_feature (1)..(1): n is a, c, g, or t
ntgtgctgcaacgactctcttaattttccaccgctacacgtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443133 - DNA, 943 bp, Homo sapiens
  misc_feature (31)..(31): n is a, c, g, or t
gtaacttaatctcgggcagtaagggggaganagaaaagttatgggcaacgactctcttaattaccaccgctacagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccgatgcgggccgcttttcgttttatgagggttaatttaatgatcctttattaattgtttcggttgtgcttcagtcctagagggtgggggtgaagcggaatccagcttacctcaagaggcgtgaattgcgggtattcctgagagactacggggaatacgggcagcaaaataccttgtggagtaactggccttttaagtagcaaaatcttgaaaaaggggccggtttggagcgtttattatataagcttccccccgcgtgatagagctgacaaaatcacacgctaagttcaaagggcgcgaagcccctggtggttcaatataactcggctcgttcccttgtatagctctctgtgtgttttttagagacactcctatcgtt

SEQ ID NO: 443134 - DNA, 415 bp, Homo sapiens
  misc_feature (31)..(33): n is a, c, g, or t
  misc_feature (35)..(35): n is a, c, g, or t
gaaagacgctaccctttaatttttgttgccnnncnaaatttggttcaagccctaccatctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccgcaaaaaaaaaaataattggccctgttggcctaa

SEQ ID NO: 443135 - DNA, 517 bp, Homo sapiens
ataattatttaaaaattagcaaaaattggaaagcacaagaaaaagcactggaggattaccaaagggaaagttagattttaaaaattcatgcattcaaaccaaccagcagttgcaacattagtaacagaacatgctgcatagctaaaacattaaaagaaaacccaagtagctctactaaatctgatgggtttgcctgcagactggtagatttagtgcttgtcacagcaactccaaatactaaggagcattgtgaaccaaatttgctgtagaatttcccagctgccgtttgtttttttaccattgcacaaatcctgttcaattgattagtcagtttggccccaaactagcttgaggaacttgatgtaggttgatgatttctttctgcagggttgttagaataattccaatttgtcaatatgtataactatttctgttagtgatgatgcataacattgcttgtgaattttccaggcagtggcttgcaatccagaagttacagggggtcctctagacacct

SEQ ID NO: 443136 - DNA, 807 bp, Homo sapiens
ataattatttaaaaattagcaaaaattggaaagcacaagaaaaagcactggaggattaccaaagggaaagttagattttaaaaattcatgcattcaaaccaaccagcagttgcaacattagtaacagaacatgctgcatagctaaaacattaaaagaaaacccaagtagctctactaaatctgatgggtttgcctgcagactggtagatttagtgcttgtcacagcaactccaaatactaaggagcattgtgaaccaaatttgctgtagaatttcccagctgccgtttgtttttttaccattgcacaaatcctgttcaattgattagtcagtttggccccaaactagcttgaggaacttgatgtaggttgatgatttctttctgcagggttgttagaataattccaatttgtcaatatgtataactatttctgttagtgatgatgcataacattgcttgtgaattttccaggcagtggcttgcaatccagaagttacgaagcaaaatccacaaaaaagtagataggaaagccagcaaaggcaggaaacttcggtgagttacttttcggaaaaaatgtcaacatatattgtatatgtatctcgtctcttacattctggctgttatgtcatttttctttttcttctgatgattctgtttttaaggatcagaaaaataaacaatatttgaaggtttattgcaactcagtttttcttattctaaaatggaaatatagtttcattgacttttgtgctactgttgtaatagatgggtgaaataatatatgcattcccttgaaagagaaaaaat

SEQ ID NO: 443137 - DNA, 2392 bp, Homo sapiens
  misc_feature (2125)..(2125): n is a, c, g, or t
  misc_feature (2179)..(2179): n is a, c, g, or t
  misc_feature (2392)..(2392): n is a, c, g, or t
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccaaaaaantaattaagagtagtggggtgatgaagaggaataagaggtaaaatatatatattnaaattggcctcgttggcctcagcggtggagctctgcggccggatccttgtatggggggtaattcatgaacctggcttcactaactcgtgcgcttggcccgtcgggtggggcgagcggatcacctcactctaaggcggggttacgggtttcccccaatccgggggatatccatggaaggacatttgatctaaagggcacggtaagggcaggaan

SEQ ID NO: 443138 - DNA, 2495 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccgatgcgggccgcttttcgttttatgagggttaatttaatgatcctttattaattgtttcggttgtgcttcagtcctagagggtgggggtgaagcggaatccagcttacctcaagaggcgtgaattgcgggtattcctgagagactacggggaatacgggcagcaaaataccttgtggagtaactggccttttaagtagcaaaatcttgaaaaaggggccggtttggagcgtttattatataagcttccccccgcgtgatagagctgacaaaatcacacgctaagttcaaagggcgcgaagcccctggtggttcaatataactcggctcgttcccttgtatagctctctgtgtgttttttagagacactcctatcgtt

SEQ ID NO: 443139 - DNA, 2327 bp, Homo sapiens
  misc_feature (2327)..(2327): n is a, c, g, or t
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcctggcctcgttggcctcagcggtggagctctgcggccggatccttgtatggggggtaattcatgaacctggcttcactaactcgtgcgcttggcccgtcgggtggggcgagcggatcacctcactctaaggcggggttacgggtttcccccaatccgggggatatccatggaaggacatttgatctaaagggcacggtaagggcaggaan

SEQ ID NO: 443140 - DNA, 2177 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcccgcgacgcgtcaagtttttgttattaatccagtgaagaaccagatcgtttttgctctag

SEQ ID NO: 443141 - DNA, 2350 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccgcttaaagccaaaataagagatgttacgcaaaaaaaaaaaaaggggggcgctaaagtacctggagggcagttacggttccagttttggcaaggggccaaagggcggtaaaggaggcgaggcgcggtaacagggcggaacggctggactcggggcccactcggggcccatgggccccagtagcgcggaaaaaaaggaggggaaccttttcgcgattgcgtgacaaacctccacagaagccagagaagtagagaaaaaggggtatactccagag

SEQ ID NO: 443142 - DNA, 2076 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443143 - DNA, 1549 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443144 - DNA, 2100 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443145 - DNA, 1012 bp, Homo sapiens
ctcgcgaccccgacgtggcttacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443146 - DNA, 981 bp, Homo sapiens
  misc_feature (1)..(1): n is a, c, g, or t
ntgtgctgcaacgactctcttaattttccaccgctacactgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443147 - DNA, 2037 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccagacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443148 - DNA, 1772 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagtttcttcgagaactcatagaagggaagacagtccttggatccaagatcagggggcatggaacgccgggttgcatccagaagtagaagaaaatcacaaaagtaattgaaaccgcaggcgggaatcggtagtctagaggaagggcag

SEQ ID NO: 443149 - DNA, 567 bp, Homo sapiens
gtaatgaatgtttcccctcttagctaatggggaggggagggctagctgcacgtctctcttattttcaccgctacagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443150 - DNA, 404 bp, Homo sapiens
  misc_feature (27)..(27): n is a, c, g, or t
  misc_feature (69)..(69): n is a, c, g, or t
  misc_feature (81)..(81): n is a, c, g, or t
ggccggaggggccgtttggggtagaanagttagagtctttggaaaaagccctcctgtagtataacactnctctttgacagnctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443151 - DNA, 349 bp, Homo sapiens
  misc_feature (21)..(21): n is a, c, g, or t
  misc_feature (52)..(52): n is a, c, g, or t
aagccgcaaagcagaaacggntcagtccttagcagttatgagctggcacctntgacctactacatgaatgatgatgccggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443152 - DNA, 2167 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccggatcggctagtcctcgccgcgtatgtggctttgtcttggtcgtgcaga

SEQ ID NO: 443153 - DNA, 2167 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgccggatgcggccgaactctttatcatatttgttgtatgtccccaccccccg

SEQ ID NO: 443154 - DNA, 1772 bp, Homo sapiens
ggcgtctagaggatcccgctgcgctactactacctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443155 - DNA, 1437 bp, Homo sapiens
tgtgctgaggtgatctagaggatcccagttcgacggagactctcgccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443156 - DNA, 1176 bp, Homo sapiens
attggtggtcaacagagctttttgtagtttgatccttccttccaagagctggtcccacagtgctatctggttcttcacggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443157 - DNA, 1065 bp, Homo sapiens
catcttgttgcctgccctcgctctagaggatccccgagtgggtcagtgtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggtttcatgtccttagcaagctactgagtttcatggcacctattgaccatactacaatgaatgatgatgccaggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443158 - DNA, 2046 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcc

SEQ ID NO: 443159 - DNA, 2255 bp, Homo sapiens
  misc_feature (2255)..(2255): n is a, c, g, or t
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggcaaacctgagccagcagctcagcctgtcccagagagtttgccaggggaaccggagatccttcctcaagcccctgctaatgctcatctgaaggacttggatgaagaaatctttgatgatgatgacttttaccaccagctccttcgagaactcatagaacggaagaccagctccttggatcccaacgatcaggtggccatgggaaggcagtggcttgcaatccagaagttacgaagcaaaatccacaaaaaagtagataggaaagccagcaaaggcaggaaacttcggacagaactgtaccgctctctttttggccagctccaccctcccgacgaaggccacggggattgacatcgcccacctccgacacccagtgggcgccttggctggtgtggctgctggtccagatggaggaaaccagtgactttatggggctgagctagtagggaagcccctggaaagatgctgcgttccgaacctgtgcctaatacacgcaagggcgctgtcccgcccaaccccgcctttaaacgccacaaataaagagcattgttaccgcctggcctcgttggcctcagcggtggagctctgcggccggatccttgtatggggggtaattcatgaacctggcttcactaactcgtgcgcttggcccgtcgggtggggcgagcggatcacctcactctaaggcggggttacgggtttcccccaatccgggggatatccatggaaggacatttgatctaaagggcacggtaagggcaggaan

SEQ ID NO: 443160 - DNA, 1629 bp, Homo sapiens
agcgggccttcatgctagcaacgcccgcagtgacgcgcaggccccgccccctcccgcgcgcctcccggaagtggccggtccagagctgtggggtggcctccgcgcggtctctggcggagtcggggaatcggatcaaggcgagaggatccggcagggaaggagcttcggggccgggggttgggccgcacatttacgtgcgcgaagcggagtggaccgggagctggtgacgatggcggggccgcagcccctggcgctgcaactggaacagttgttgaacccgcgaccaagcgaggcggaccctgaagcggaccccgaggaagccactgctgccagggtgattgacaggtttgatgaaggggaagatggggaaggtgatttcctagtagtgggtagcattagaaaactggcatcagcctccctcttggacacggacaaaaggtattgcggcaaaaccacctctagaaaagcatggaatgaagaccattgggagcagactctgccaggatcgtctgatgaggaaatatctgatgaggaagggtctggagatgaagattcagagggactgggtctggaggaatatgatgaggacgacctgggtgctgctgaggaacaggagtgtggtgatcacagggagagcaagaagagcagaagccactctgcaaaaacaccgggcttcagtgtccagagtatcagtgactttgagaaatttaccaagggaatggatgaccttgggagcagtgaggaggaggaagacgaagagagtggcatggaagaaggggatgacgcggaagactcccaaggcgagagtgaggaagacagggctggagatagaaacagtgaggatgatggtgtggtgatgaccttctctagtgtcaaagtttctgaggaagtggagaaaggaagagccgtgaagaaccagatagcactgtgggaccagctcttggaaggaaggatcaaactacaaaaagctctgttgaccaccaaccagcttcctcaaccagatgttttcccattgttcaaggacaaaggtggcccagaattttccagtgccctgaaaaatagtcacaaggcacttaaagcattgttgaggtcattggtaggtcttcaggaagagttgcttttccagtacccagacactagatatctagtagatgggacaaagcccaatgcgggaagtgaggagatttctagtgaagatgatgagctggtagaagagaagaagcagcaacgaagaagggtccctgcaaagaggaagctggagatggaggactatcccagcttcatggcaaagcgctttgccgactttacagtctacaggaaccgcacacttcagaaatggcacgataagaccaaactggcttctggaaaactggggaagggttttggtgcctttgaacgctcaatcttgactcagatcgaccatattctgatggacaaagagagattacttcgaaggacacagaccaagcgctccgtctatcgagttcttggatctttctcagcccctgttatggttattgaagacttggtgaagaaatttttatgaagaagacttttacaccagttcttgggaacttattaaacgaaaccccttccttggatccaacatcagggggcatgggagggaaa

SEQ ID NO: 443161 - DNA, 661 bp, Homo sapiens
agagatccccttcgattggcgggccacttatgcacgcttaactatcttaacaagctttgagtgcaagagattgaagagttcaaatctgaccaagatgttgatgttggataagagaattctctgctccccacctctaagttgcccgcccatcgaatcgattggcgggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaatcagatcaactgtccgccaatcgattcgattggcgggcaacttatgcacgcttaactatcttaacagctttgagtgcagagattgaagagttcaaatctgaccagatgttgatgttggataagagattctctgctccccacctctaagtgcccgccaatcgaaggaccgctga

SEQ ID NO: 443162 - DNA, 360 bp, Homo sapiens
  misc_feature (11)..(11): n is a, c, g, or t
gagctgcgtcnggtagccaagccccattcctgcgagacacctgttgtgcctacttgcggatttcaccgcgcccgttcctccgccccccacttcccacacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaataagcctcactgttactaaggggagtctgaagtagcaagataccgggatacatcaa

SEQ ID NO: 443163 - DNA, 4027 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgtaaaaaaaaaaaaaaaaaaacctcgtgccgaattcggcacgaggcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaaactctctctttttcagtgaataaatggaaccccaaataaagaaaaaaaa

SEQ ID NO: 443164 - DNA, 3387 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443165 - DNA, 4113 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatgtaagtgatgatgatgagctcattgaaaacagggtatgcttattaaatcctatagattgtaggattggaggtattgccctctcctggaaacattgttctgagtagtttgatcaccactagatgatggatcctgtgtgggggagcgctgctgggtgtggaggggtatgaggactttcgaagagtgcaagacaccatcctccttgaggggcttgcggaacagttggggaaataggacataggccaagggatgagctcgaaataaagtagggtaacagttccacaatttgggggttctactgctagtcttcctcaagattccagctctaatggatgtttttatttaattctagggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443166 - DNA, 3507 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggaattaggaacccaagaagctaagccaggagctcagcattcaaggttggaagtccaggacaggtccggttc

SEQ ID NO: 443167 - DNA, 3737 bp, Homo sapiens
  misc_feature (18)..(18): n is a, c, g, or t
  misc_feature (21)..(21): n is a, c, g, or t
attacgttcccccccggntantccgaggcctggtggccactcggacgagggtaggacttggtattcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443168 - DNA, 2416 bp, Homo sapiens
agagaagcccaacttcagctacatcatcgggaagaacacttgggtggagcactggcctgaggaggacgaatgccaagacgaagagaaccagaaacaatgccgggacctcggcgccttcaccgagagcatggttgtctttgggtgccccaactgaccacacccccattcccccactcccgtaccagctggtacgggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443169 - DNA, 2071 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgaggtatccgtgagggggtaccgagccga

SEQ ID NO: 443170 - DNA, 917 bp, Homo sapiens
ccttcgatgggcgggcacttagaggtggggagcagagaatctcttatcaacatcaacatctggtcagattgaactcttcaatctctgcactcaaagctgttaagatagttaagcgtgcataagtgcccgccaatcgaattcgatgggcgggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443171 - DNA, 960 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaaaaacacaacaaaaaaaactcttttgggcggcttgggccctggaaaagttttttaacccttcggtttgtggccgcgcgcggcccccatgcgtgccatgtggaaccacggtgtccatataggctgttcccgaggagaaactcggggccgggaactgagggctcggagatttcccccctttaaaaaggcccggggggaaacccgaaggttctcgtgaccacaatctcccgaatattggagcttctcgagaggggccaatacaggggacattctatccacccggcgaattccccaagggcgaagcttgcaattcccaattagcccccggttgtgtagggtggaacagtaaaagctgacagagcaaataaatcgcacatgaaacaaagaacaacaccacaatgaagccaagaaaacgagatcagaacagtagcatgtgacatagaatccacaccaaaaatgcacaataacacacagcgcatagaacgagcgcgcacccgacgatcttgaaacacacgcaagacgacaacaaacacaaa

SEQ ID NO: 443172 - DNA, 150 bp, Homo sapiens
ctttgtgggggtgtggtgaaggtgtgtgtggcccagcaccgtgggactacaccatctcagtacagacatgcacatactcaggatgcagatacgcaaatgggctcatgtggaagtcactgcgttaactcagattttctttctccaccaaag

SEQ ID NO: 443173 - DNA, 577 bp, Homo sapiens
cttgaggggcttgcggaacagttggggaaataggacataggccaagggatgagctcgaaataaagtagggtaacagttccacaatttgggggttctactgctagtcttcctcaagattccagctctaatggatgtttttatttaattctagggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggtaactggcatctttggaatatcttcagaatgactctgcattaaaagttcacttattctcccagttccctgacggaaactgcattccacattcaaggtaaagatccctactatacagtgactgcagtatttctctggtattgaaaagtacttaaggcttttcagggctcaaacgggctgtgccagaggattgaaaaggatcagtgggacttaagttatgaaaatgagatccttggaatgatctcttaagaacagcagatgcctgaaggaaata

SEQ ID NO: 443174 - DNA, 2434 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtaccttt

SEQ ID NO: 443175 - DNA, 3763 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443176 - DNA, 4270 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgtatgtaaaaacacaaaaacaaaaaacaaacaaaaaaaataaatcacacaacacacataaacaaacaaaggagaacaacagaaatcaaaagtagaaccataggcagtacgcactagagaagagcagagagaggagagcacccaaacacgagggcacgccattccagcgggcacgacgagggtgcgagggcgggccgccgcgccgagcgccgggggggggaggggacgccgcggatatgcaccgatccgctcagcctaagggtctagttgcccggaatgacaaagagggatgcagtcgcccacagcatgagttatctgtgccagactctccaacaagtggacgacatcgaccagccagcgtggcgtgtgcggcgtccggtcgactcaggctggagcggtcgacacggaaggctctgccggccgccgcacgagctgggccccgagccatgggcgagggtgaccctggagcgagacacagtccgcaaggtgggcccgtcgtcgcgcatgtccg

SEQ ID NO: 443177 - DNA, 3706 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggtattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 443178 - DNA, 3359 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgtgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaatgcccgccaatcgaagggcaacttatgtaatacaatagtg

SEQ ID NO: 443179 - DNA, 2238 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgc

SEQ ID NO: 443180 - DNA, 1940 bp, Homo sapiens
  misc_feature (1912)..(1912): n is a, c, g, or t
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctttgttttcgattttaaggagccttccctcgcttancctgaacgccaaatttttttatgcatta

SEQ ID NO: 443181 - DNA, 528 bp, Homo sapiens
agctgaccacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaataagcctcactgttactaaggggagtctgaagtagcaagataccgggatacatcaa

SEQ ID NO: 443182 - DNA, 920 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaa

SEQ ID NO: 443183 - DNA, 3000 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443184 - DNA, 582 bp, Homo sapiens
ggacgcgtgggtcgaccacgcgtcgcccacgcgtccgacagaattgaaagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaaaaaaaaaaaaaaaaaaaaaaaaaaaaaaaaaaaaaaaaaaaaaaacaacaagaagcgacgaaccaaagaagaaagccaaagagaaaacaaggaaaaacaaaaagcgaaatatcaaaaaaagagaaacaaaaagagaaagcaaaacacaaaaaaaacatggaagcaaaagcccaaacggaaaagagaaaaaggacgacaacaatcacaaagcagaagacaaaaagagaggagagcaaaaatgcaaagggaaacaaagaggacaacaagaaagaaaagcaac

SEQ ID NO: 443185 - DNA, 327 bp, Homo sapiens
agctgacgtttgagcacgtagttagtgaaaacttcacacttcaaagtatgcgaaaaggaagaaaagtacccataaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttcacggcactcagtgccacagccaatctcagctaaccacagtcagcctccctctcacttcaggcagttctcataggtcacaaatcactttctcacc

SEQ ID NO: 443186 - DNA, 3015 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagaccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443187 - DNA, 2857 bp, Homo sapiens
catataatgagcacagtctgagagagcgtgacgactatgagggccgatcgtcggtgtaatctctcgtggcgtgtgacgaccctcgcggtggtcaccactccgaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443188 - DNA, 3743 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaaaaaaaaaaaaaacaaaaaaaaacaaaaaaaaaaaaaaaaaaaaaaaaaaaaaaaaaaaaaaaaaaaaaagacagagagagagagagagagagagcacacgacgagagagaggcgagcgcgcggcgcggggagacaagaaaaaaaagaaagacgaggaagaaacaaaagaaagacgagggcgacgagagagaagcaactacagacgccgaggggaccacacccgacgagcgcagaggagagcgaactacgcggaccgaggagagagaaaaaaaaaagacgacacccaggcaccaaaaaagaaaagaaacagaaaacaaacccgcgagcaaagaaaagaaaaagcgggacagcagagcgaggagaaggaaaaccgccaccagctacacccacataaactcccccccaacagtacaactacaacagaacaatataccattaaaccacaaaaacatactacatcaccccccaatatattctcacacaacatcataacacaaacaaaaaacacacacaacaatctagccccgaaacccacacaggaagcagcgcgagacgcgacagaccagcgccgagagcgacaccccagaaaaagaaaacaagcaagaggcgcacgcacagaaaacgccacaaacaggaaacacaaacaaagcagaagagagaaaacacgacccgacccaaaacccacc

SEQ ID NO: 443189 - DNA, 3177 bp, Homo sapiens
  misc_feature (3062)..(3062): n is a, c, g, or t
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaagaacncacaacacaacacaccacacctcacaccacaaacacacaaaccaacccccccacaccccactcaccacccaactatcacctcataccacaccccttcatccgaacacaactaata

SEQ ID NO: 443190 - DNA, 2714 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443191 - DNA, 3003 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443192 - DNA, 1645 bp, Homo sapiens
gctcatgtgccttccagacggttcaaggcagaggccactgtgctcagtgtagtctgtgatgaatagtttatgctgtacagcataaactattactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443193 - DNA, 1529 bp, Homo sapiens
ggacgcgtgggtcgaccacgcgtcgcccacgcgtccgacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443194 - DNA, 2291 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatga

SEQ ID NO: 443195 - DNA, 1225 bp, Homo sapiens
tgatcactgtaatatcccaacgcctaacgatcccagggttgatcatggtcacttgtcaaatgctgactgcatagtcctgccatgaactatggactgtgcgcttgctttctctctacaccttacctatcgtccgcgttgcccatcgtatattatgcatgcatacttaagcttctatgaggtttccctccttgtaataactgagttcaatcattgcagtccatagcagagtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443196 - DNA, 1811 bp, Homo sapiens
  misc_feature (1716)..(1716): n is a, c, g, or t
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtacttcagacttcttggggaggcgaggatttactcattcgagccgtacatttantggacacccatttctgaacgttttcatcacaccattgcttgaatcaggccgttccacccgagtgggaggcgtattctggcggaggttttcttgga

SEQ ID NO: 443197 - DNA, 1773 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgtgggtatgctagcactattgtacctgtaaggatgtccacagaatgtctgagtagtgactctcggggggcgcggcttccttcttccaccttcctttacgggcaccatttttcgacctcttctcggcaccttagttcgacggccgttccccggttgg

SEQ ID NO: 443198 - DNA, 900 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccggtgatcctaagagtcgaagtgcatgcatacaagagactaaaatcaggcaagctagaaccct

SEQ ID NO: 443199 - DNA, 559 bp, Homo sapiens
gcatctttaaattacaatagaggaccatgaaacttaggattgttgtttcttttgtcttatctaacagggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagac

SEQ ID NO: 443200 - DNA, 3057 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443201 - DNA, 3007 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatcctaagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443202 - DNA, 2997 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443203 - DNA, 3425 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaaaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatcaatagaaattatgctgtagttttccaataatttttgagaggaatactatcttggttttataatctgaaagctagtttgtgactttctgcctttttagttcatattgcatataaagtaaaaaccaagaactatttggtataaatta

SEQ ID NO: 443204 - DNA, 3003 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatatgcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 443205 - DNA, 3144 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttggtaagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggctttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaaaaaaaaaaaaaacaaaaaaaaacaaaaaaaaaaaaaaaaaaaaaaaaaaaaaaaaaaaaaaaaaaaaaagacagagagagagagagagagagagcacacgacgagagagaggcgagcgcgcggcgcggggagacaagaaaaaaaagaaagacgaggaagaaacaaaagaaagacgagggcgacgagagagaagcaactacagacgccgaggggaccacacccgacgagcgcagaggagagcgaactacgcggaccgaggagagagaaaaaaaaaagacgacacccaggcaccaaaaaagaaaagaaacagaaaacaaacccgcgagcaaagaaaagaaaaagcgggacagcagagcgaggagaaggaaaaccgccaccagctacacccacataaactcccccccaacagtacaactacaacagaacaatataccattaaaccacaaaaacatactacatcaccccccaatatattctcacacaacatcataacacaaacaaaaaacacacacaacaatctagccccgaaacccacacaggaagcagcgcgagacgcgacagaccagcgccgagagcgacaccccagaaaaagaaaacaagcaagaggcgcacgcacagaaaacgccacaaacaggaaacacaaacaaagcagaagagagaaaacacgacccgacccaaaacccacc

SEQ ID NO: 443206 - DNA, 1820 bp, Homo sapiens
  misc_feature (1635)..(1635): n is a, c, g, or t
  misc_feature (1820)..(1820): n is a, c, g, or t
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgtgactatgtgcttgaangattccacaaatgtctgagtacgactcctggggagcagcaggattactatttgagcacttcatatcagggaacgcttttttcaacaccattttaggagaaattcgttgatacagccgtatcaccagttgcgcgaggcaataggcggggtttcctgtcgtatattttcgtcgttttggtttcgtgn

SEQ ID NO: 443207 - DNA, 1727 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatcctaagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgtggatagagcttgattaattacacttcctttgtacttaacttctttgtgagcaagaagatatcattatttagatcattactatttaatagacaatctattatttagatatttattttaatagacatcattttagttttagatacaggtgacctgtg

SEQ ID NO: 443208 - DNA, 778 bp, Homo sapiens
ctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcagcgacaaacgccaggggttttccaattcagcaactctgtgcgacgactgcgaccgttgatgcagccatgtccagcggaggaattgtcgtggtttcgggcacggcagcacgataactgtctttactttaattcaatcgggtccattcacaagagatcgtgaataaccacatctctgtgaacagacgcatttgaattaataaggacatgagctcactgtgcatcatc

SEQ ID NO: 443209 - DNA, 485 bp, Homo sapiens
ctctcccatacacactcaccaccaaatagcctatagagcagaacttttgggggaattcctgtagatcatttataaatgctatttattccttataatcacaaactgccttataatttgcaaagcacttaaaaaaaatttcagttgatttgtccaagcaccctatgatggtacataggtccattatcacaattttacaaaagagaaaatgagcctgagaggttaaataccttgcctaaaacttgaaaatggtgctatcagaactgaagccaggatttcgtgaccaatcttgtcctgccactatatcttattatgacctgtataaaacacattattctaataaggagtggtgaattaattcaacttaattatctttgaggccgggcgcagtgcctcatgcctgtaaacccagcaatttgggaggccaaggagggcagattgcttgaagcccggagtttgagagcagcctggccaactagcaaaacccc

SEQ ID NO: 443210 - DNA, 660 bp, Homo sapiens
ctctcccatacacactcaccaccaaatagcctatagagcagaacttttgggggaattcctgtagatcatttataaatgctatttattccttataatcacaaactgccttataatttgcaaagcacttaaaaaaaatttcagttgatttgtccaagcaccctatgatggtacataggtccattatcacaattttacaaaagagaaaatgagcctgagaggttaaataccttgcctaaaacttgaaaatggtgctatcagaactgaagccaggatttcgtgaccaatcttgtcctgccactatatcttattatgacctgtataaaacacattattctaataaggagtggtgaattaattcaacttaattatctttgaggccgggcgcagtgcctcatgcctgtaatcccagcactttgggaggccaaggtaggtggatcatctgaggttaggagtttgagaccagcctggccaacacagtgaaaccccatctctactaaaaatataaaattagctgggcatggtggcacatgcctgtaatcccagctaattgggaggctgagacaggagaatcacctgaacccgggaggtggaggctgcagtgagccaagatagcaacgcagcactccagcctgggcaatggaatgggactccatctcaaaa

SEQ ID NO: 443211 - DNA, 734 bp, Homo sapiens
  misc_feature (578)..(578): n is a, c, g, or t
cttttaaattgtttttacccagtgcacaaaacgaaaatattttaaatacttttgtagttaaaatgctttaaattttagggaatattctttaacagttttcagtaattttaatcatctacttttctgttttatagtaaaatatttttacatgtgtctaggtcaaaaaatatatatttgtctgtattacgttccagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcagtgaatctttngacgtgaccaaacgatggagaatgagcttctcgaaagtgttcatcgcagctaaaccgtgtccaatttgatgacgaagtcctcggttggccaccttttcaggcacactattcagagatattctaagtctcattcattggaagggggctgcccttagt

SEQ ID NO: 443212 - DNA, 2541 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443213 - DNA, 3545 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaaaaattttagtgatcatggtaagataaacattaatatatgaatgaatattactgcttttaaattgtttttacccagtgcacaaaacgaaaatattttaaatacttttgtagttaaaatgctttaaattttagggaatattctttaacagttttcagtaattttaatcatctacttttctgttttatagtaaaatatttttacaagtgtctaggt

SEQ ID NO: 443214 - DNA, 2474 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgaggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443215 - DNA, 1473 bp, Homo sapiens
gaggatcgcaattcgacagtgtgcaaaggaagtttagaagtatggtttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443216 - DNA, 3491 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaattctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaaaaattttagtgatcatggtaagataaacattaatatatgaatgaatattactgcttttaaattgtttttacccagtgcacaaaacgaaaatattttaaatacttttgtagttaaaatgctttaaattttagggaatattctttaacagttttcagtaattttaatcatctacttttctgttttatagtaaaatatttttacaagtgtctaggt

SEQ ID NO: 443217 - DNA, 1924 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttccttctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 443218 - DNA, 1917 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgaggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtaagagttgtatgaagttt

SEQ ID NO: 443219 - DNA, 1917 bp, Homo sapiens
cttttaaattgtttttacccagtgcacaaaacgaaaatattttaaatacttttgtagttaaaatgctttaaattttagggaatattctttaacagttttcagtaattttaatcatctacttttctgttttatagtaaaatatttttacatgtgtctaggtcaaaaaaaaaaaaaatctcaagtgaccatggcatgttttaggttcatgtatgtagttgaattgtttatatatttgtctgtattacgttccagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaaaaattttagtgatcatggtaagataaacattaatatatgaatgaatattactgcttttaaattgtttttacccagtgcacaaaacgaaaatattttaaatacttttgtagttaaaatgctttaaattttagggaatattctttaacagttttcagtaattttaatcatctacttttctgttttatagtaaaatatttttacaagtgtctaggt

SEQ ID NO: 443220 - DNA, 1635 bp, Homo sapiens
acccactatgcccagccaagttaactttaatatgttacattttgtttttaaaaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaattacatagttttgtttttacaattctgaaatatatgaaaaacttagatagaatatgtcatatgttattataacagatctcttcctacatcttatttttcttctttgtatacagtagtgacagtttaccttcagtcatcctacaggtcacctctgtgcccaacaactttacttgcctacaacggttcacaaactggaacaggccatattcaaagccagtgcctatttcttcagaactgttaacagatatagtgagttgagggagctaatctgatacacttttgataatataatgcctttcaaattagttaccaaatcataaacagagtggaataaatataaattagattctaactaggatgaatgtggtagtaatgatgtatatttttcaaatttacctaaacagaaagattattggctaaggcaggcggatcatgagatcaggagatcgagaccatcctggctaacacggtgaaaccccgtctctactaaaagtgcaaaaattagccgggcgtggtggcgcatgcctgtaatcctagctactcaggaggctgaggcagaagaatcacttcaacccaggaggtggaggttgtagtgagccgagattgcgccattgcactccagctcaggcaacaagagcaaaactccgtctcaaaaaaaaaaaaaaaaaaattttagtgatcatggtaagataaacattaatatatgaatgaatattactgcttttaaattgtttttacccagtgcacaaaacgaaaatattttaaatacttttgtagttaaaatgctttaaattttagggaatattctttaacagttttcagtaattttaatcatctacttttctgttttatagtaaaatatttttacaagtgtctaggt

SEQ ID NO: 443221 - DNA, 1089 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataaggctgatccatgaagggttttaaacatatctacctcacaacttacattcctaagtgaagtcaaatcccgaccatcgcacctt

SEQ ID NO: 443222 - DNA, 334 bp, Homo sapiens
ttgtacagatgacctaagtcttcttgtattgcatttttatttttaaacaggaaattagaaatatcttctggaaagctggccagatttgcagatggctctgctgtagtacaggtaaaaagtccagatttttaaaattcatcttaaaaatggttacggagactcatactaaatgtgtaactacaacatcgtgtaactacttagaattttggtactggaaattaattcagatactactaagataatttctactgcaagaatcattccagacaaccagagtccagagcactgcatgtattaagtgacctatttttttttttgaggtggactcttgctc

SEQ ID NO: 443223 - DNA, 2535 bp, Homo sapiens
gtgtaagaatagcaatagggacggcctgtggtattcggccgaggctggtgtatggctaagctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443224 - DNA, 2658 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatctta

SEQ ID NO: 443225 - DNA, 2636 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcggtaagtataaaagtagagattaaaattatcagattaaaaatttttttaaagcaatgaaattttaatttcggccctgatttttctccttttttaagcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443226 - DNA, 1758 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaatacc

SEQ ID NO: 443227 - DNA, 2190 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtaggtaatacattaaaattttagtgatcggctgggcgcggtggctcacgcctgtaatcccagcactttgggaggccgaggcgagcggatcacaaggtcaggagatcgagaccatcctggctaacacggtgaaaccctgtctctactaaaaaatacaaaaaattagccgggcgtggtggcgggcgcctgtagtcccagctactcgggaggctgaggcaggagaatggcatgaacccgggaggcggagcttgcagtgagccgagatcgcgccactgcactccagcctgggcgacaaacgtgagactccgtctcaa

SEQ ID NO: 443228 - DNA, 1311 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatatacccaacaaataattcagggcattcagcagttggtaaaagaaactggtgttaccaagaggacacctcagaagttatttaccccttcgccagagattgtgaaatatactcataagtaagaacatctgtgcaaatgaaaatatgaaattgtcatcagatttaatttcctcgtgggagagaaacttcccatggaagcactgcccatgcattacttcataaatagcacttttctgttttaagagtcattcccataaatatctgcttactcccttaaaaaggataagcccacatcactcttgtaagacctaactttgaatctcaaatgaaagagtgtgtttattggtcaagattcaggtaagcaccacatctctccacgtctaggaaaaagaataaaacgttaagatatttgaatatctaaggaaactgttggaattctcaaaaagaaatcagaggtaatcactgttacatgcccagtgcttagaacgttaggcagacactcagt

SEQ ID NO: 443229 - DNA, 915 bp, Homo sapiens
aagcagtgctatcaacgcagagttgccattacggccgggggaccgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtacta

SEQ ID NO: 443230 - DNA, 1729 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagacctcagcagggcccaggttccagcccagatcccagcatgtggtcagagctggtgtgactgaagccaacaggtgacacggtcatcgaagagcagcagacaaaactaaaactaacccaaaggcagctgaaagtggagggcaggtgaattcccagccctcgccggattcaacttttgccaacggtgaagaactgccctgagctgcaaaccttacaaagtctgtaactctagataaaccataccatgtgctaactgcactgaaataaaacactaactacattataatgtca

SEQ ID NO: 443231 - DNA, 952 bp, Homo sapiens
gctggaatacaggccatagtttgatgagaaatggaatggcctgtattccaggacatagtttgatgagaaatggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgataacttacccatgggttgactgggtacttcccttgatcctatcacaacgtggtggaacttcacctttgccaactgatgaaaacgtgaagcagatctcctgttcccctggcatcctgcacggcgatgaggacgaaccagagggagacccttacacaacgtggcagaaagcgtctatagaaatcgccgaacagagagtcgaagcgctccgagatccaaagtcacgtaggggcctaaatcaaacctgggctacagccgaaaatgatggcaagagccgagtgccaggaacg

SEQ ID NO: 443232 - DNA, 624 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggtgaggcttcgcgcggagcggggggggggggggggccggtccctcactttgcgcaggtgcgtcccgcagggggccgcggtacctcccagcccctcccagagtggccgtccgcccgatccgcggccgcccccgtccgcgcctgtgtcccg

SEQ ID NO: 443233 - DNA, 1881 bp, Homo sapiens
  misc_feature (1828)..(1828): n is a, c, g, or t
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcaccgtggtagcagcatcgcgtctagaagtcccgaggtcgggggtacggcgcccctgcgaaggcgctgtcgagtagccccgggtatggccctgaaggcatgggcgtggtagtgtgaagagcgggtggggtaggctagggcaagtgtaggcgtcgtgccctgtgaccagctcccttcgaacacgtgaagagatccttagtataggggtagaaacgttaaatggtcgangacagtgtccagcgcagtaactacctagccttggctttgaagtggcctagcga

SEQ ID NO: 443234 - DNA, 1862 bp, Homo sapiens
gagtccttggaagatccctggacgccaggcacagcagaggcgggaggcagaggggccggcgccagaccctgagagcgctggggcccactcggacctcctcctcctgctctgcatcaggccccacaccgagcgcccgggcgggcgcccctcgggctgggctgcgtgcgcggagccttactggcgccttgggccctcggcggctctccccggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443235 - DNA, 1690 bp, Homo sapiens
cgggaggcctgaggaggccgctctttcctgatacgaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443236 - DNA, 2278 bp, Homo sapiens
tcccccgggctgcaggttttttttttttactttttaaaaagaatcacagccaaaataagacattaactgcaaaatccaaaatggctgcgcttaccctatgtatatgcgtccagtccggtcggggcacggcctatgctttcccggggatcttggcccgcttgcgtgcaatagcatcctccacggccttcagctgtttcagcagctcctcccgccgagacagcgtgctggccttccctgatttggtgctggcggcgccgggatccgaggctttgccgggcacgctcgtgaccttgctggagctcttggactggggtgacagctggcgcttcctgtcagccggggctgcaggggctttggagttctggcctctctgccgctctggcttcggggagcccagtctcccacctgacttccggtcccgagaacctgggtgataggtacagagtgagaccaccctcctgatgtacagggaatggctgtgtgggtggcctcaccgatgccagggactcacttctaaagcctgaggctgcttagttcaccaccttcatttttatctcgtgccgaattcggcacgagctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443237 - DNA, 2008 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctgaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443238 - DNA, 1499 bp, Homo sapiens
tgatgactcactgctgggctgctggaaagataattgcactccacctttgctggagactgggggagggacccttgggaggttgtaattttggggggcagagatggtagtgttttctgttatggaaacaagatgctaattagaccctaaggggaaacagcccctttccccttcctgggtcatggttgccttgaacccagaaatgccctccctgttctgggagcctccggactccactccctgtcctgcccctgaccaagccttcggcgttgaggaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443239 - DNA, 1560 bp, Homo sapiens
gtacccacctgggcctgagtgcagagcccaagcctgagggtgaggccttggcagtagtgacaagggcagtgtgtggaatggaccaacccccggcctcctctgtactgccctgggccctatgcaggttgctgcccagactcgcctacctgcctgtcagaggacacaggcccccaccccactgcctggctgtgtggccttgggcaagatgctaaccctccctgtgcatgggacaaggcttctgagccgaggagggcatgtggtacttcgaccctaagcactggacccacggaggggctgctgctaatggtgatagagttttttgttgtgttgtgccagtcagctccaaaaagtaggtcaaggtgccagtttctccctgcaggggactgaaattggtggcctgaattgcctcccagtgctgtatatcccgtgagtaattctactgcaaacttctgcttttctccagttgcctttggaagttccagaggcaaaactgtgtccctttagcacaggtacctgggttgctaagggggcagtgggctcagagtatgggtttgctttgcggttataattttccccattataaaaggaagatatgtgtagaaaatttagaccagagaatagctctgaagttgagggtcaagaatcagagaccttgtctccatgcctgtgtgttgggctttgacttggcaccacactgcttgttccctgcctaactcactgagtgctgctctgggctacagcgcatcctcatggggctcttggctgcctcctctctgcacagcctctgcttccttagatagcagtgtgaggactgtggagaaggatctttggtctgagctcaaatgattggctcctgattgtcctgtggtctagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443240 - DNA, 2128 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443241 - DNA, 2082 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443242 - DNA, 2138 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaagggaggcggaccaccggggtgagcctttaccagggtgctggagttcccttgggtttaccattgtggtcaccttttgactccggaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443243 - DNA, 2248 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcggtccctgtgccccttcccagctggaggactttctgtgctagtgttgctccccagcactggatttctgtccacagaagactacactgccctgggggaccagcgtatctgtcttcagctgagtaagagttccctatttcattgatttgaaaaaaccacaggatcaaggtttgaatcacacgtgtaactactacctgcagccagaggaagacgtgaccattggagtctggcacaccgtccctgcagtctggtggaagaacgcccaaggcaaagaccagatgtggtatgaggatgccttggcttccagccaccctatcattctgtacctgcatgggaacgcaggtaccagaggaggcgaccaccgcgtggagctttacaaggtgctgagttcccttggttaccatgtggtcacctttgactacagaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443244 - DNA, 1962 bp, Homo sapiens
ggccagtgatgctggtgcgcgcgctccttggaactagagaggaggtggccggggcggggccgggggaggggggtagggcagagcctggcgggagcccggctgctgattggccggcctggctggcgggcccccgccgctggttcgtagccggcgcagcggcctgggctgggatgtgaggagcggcgggttccgggctccgggctctgggtggcggcggctgtgagcggcggcactgcggcgcaggccagcgggcgccgtcggcggctggccctgtcggccgcgggatgaggaagcggaccgagcccgtcgccttggagcatgagcgctgcgccgccgcgggctcgtcctcctccggctcggccgccgcggcgctggacgccgactgccgcctgaagcagaacctacgcctgacgggcccggcggcggctgagccgcgctgcgcagccgacgcgggaatgaagcgggcgctgggcaggcgaaagggcgtgtggttgcgcctgaggaagatacttttctgtgttttggggttgtacattgccattccatttctcatcaaactatgtcctggaatacaggccaaactgattttcttgaatttcgtaagagttccctatttcattgatttgaaaaaaccacaggatcaaggtttgaatcacacgtgtaactactacctgcagccagaggaagacgtgaccattggagtctgaggaggcgaccaccgcgtggagctttacaaggttggggtgactcagtgggaacgccatctgagcggggcatgacctatgacgcactccacgtttttgactggatcaaagcaagaagtggtgacaaccccgtgtacatctggggccactctctgggcactggcgtggcgacaaatctggtgcggcgcctctgtgagcgagagacgcctccagatgcccttatattggaatctccattcactaatatccgcgaagaagctaagagccatccattttcagtgatatatcgatacttccctgggtttgactggttcttccttgatcctattacaagtagtggaattaaatttgcaaatgatgaaaacgtgaagcacatctcctgtcccctgctcatcctgcacgctgaggacgacccggtggtgcccttccagcttggcagaaagctctatagcatcgccgcaccagctcgaagcttccgagatttcaaagttcagtttgtgccctttcattcagaccttggctacaggcacaaatacatttacaagagccctgagctgccacggatactgagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgca

SEQ ID NO: 443245 - DNA, 4244 bp, Homo sapiens
  misc_feature (446)..(446): n is a, c, g, or t
  misc_feature (578)..(578): n is a, c, g, or t
  misc_feature (593)..(593): n is a, c, g, or t
atggcggcgggctcggatctgctggacgaggtcttcttcaacagcgaggtggacgagaaagtgggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaatt

SEQ ID NO: 443246 - DNA, 4057 bp, Homo sapiens
  misc_feature (831)..(831): n is a, c, g, or t
  misc_feature (963)..(963): n is a, c, g, or t
  misc_feature (978)..(978): n is a, c, g, or t
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaaga

SEQ ID NO: 443247 - DNA, 1799 bp, Homo sapiens
agggaagaagaaggaaaggagagggactattgcatagcagatgcaaatgaagggacttggggctagtcaggaagaaagggaaagggaaggaaggcaagagagaggggtgaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaatt

SEQ ID NO: 443248 - DNA, 1126 bp, Homo sapiens
  misc_feature (135)..(135): n is a, c, g, or t
  misc_feature (152)..(152): n is a, c, g, or t
  misc_feature (279)..(279): n is a, c, g, or t
  misc_feature (281)..(281): n is a, c, g, or t
  misc_feature (285)..(286): n is a, c, g, or t
ccagctctcagcagatcccagtgttcctgaacacaaagctctgaccctgccgatgcgctttagggcctgcttcccaaggtcctaaaaggccaggcctttctgagaggactaaggacattttggtgaaaacctgantttggtttgtatgacangaggggcctctttttgttgacctgacactttcctttttaaagacacagaagaggctgggcacagtggctcatgcctgtaattgagaccatcctggccaacatggtaaaaccccatctcccacttaananactnncgaattcggcacgagattgtgaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaatt

SEQ ID NO: 443249 - DNA, 3444 bp, Homo sapiens
  misc_feature (831)..(831): n is a, c, g, or t
  misc_feature (963)..(963): n is a, c, g, or t
  misc_feature (978)..(978): n is a, c, g, or t
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggcctccgtggcactcagtaagcagcgggctcagggagagcgtcctggatggtcaccatgcaggtaagatgaggaggacacttggaaccaggcattggatgcgagccccaccccatgggagggggacggggggatgctgggcaccagggggacctgtgggccagctggccctgggcttgtgcttggggagtgaatgatgggttctgacccccatgcacccctgtgggcccctggcatcactggccccatccttcacccctgccaaccacgcttgccctgtgcctctgaagctcccccactaagggggtggagtctaattccctgccccttgactgtgggttcagccatgtgacttgctttg

SEQ ID NO: 443250 - DNA, 2079 bp, Homo sapiens
  misc_feature (831)..(831): n is a, c, g, or t
  misc_feature (963)..(963): n is a, c, g, or t
  misc_feature (978)..(978): n is a, c, g, or t
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggtgagaaaccttgactttacattccctttcccctaaagcctgttgcataggacagacacctgttgctgctgtgacctgtgcccgggaggcctgtgccagcagggagagctcctctggaaggctgcaggcgaaggggaggggtgcacacgtgtcgaaggcgtgtgtggcctagctaaggagactccttcctggggctgggtg

SEQ ID NO: 443251 - DNA, 156 bp, Homo sapiens
cagctggtggcgtgagatgcccttaccttgtgtttttggattcttgtagcctcagctcgttctgggtggcgctgcccagacggcttcacttgggacggcgacggctgttcagacggggactcctcagcgcacggtaccaggggcgaccaccacttc

SEQ ID NO: 443252 - DNA, 4629 bp, Homo sapiens
  misc_feature (831)..(831): n is a, c, g, or t
  misc_feature (963)..(963): n is a, c, g, or t
  misc_feature (978)..(978): n is a, c, g, or t
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaatt

SEQ ID NO: 443253 - DNA, 1939 bp, Homo sapiens
tgtattggtggtgctggcaggaaggccactcaatcaatatgagttaagatttaattgtcctttaagagtatccgcaggcctttgtgttctctctgttacagaaacgtgttttctttcacactgaagagctgatttagaaacaggaatataaaactgttccattgtaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaatt

SEQ ID NO: 443254 - DNA, 2557 bp, Homo sapiens
  misc_feature (831)..(831): n is a, c, g, or t
  misc_feature (963)..(963): n is a, c, g, or t
  misc_feature (978)..(978): n is a, c, g, or t
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcgggggcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccacnctggcccggccgcccggccaccccgccggacccccgaccgccgcgcccgccgtgccgccccccgccgccgcccagaacgggggcagcgccggggcagcccccgcccccgccccggccgccgggggccccgcnggggtcagcggccancccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcagtccctgtggtgaaacccgccgtgttacctggaaccaaagccctttctgctgtctcggcacaagcagctgctgcacagaaaaataaactcaaggagcctgggggaggttcgtttcgaaccctcagaaatgctgtactgctccaggcgtagtggctcacgcttacagtgccagcactacaggaggctgaagtgggagaatcgcttgagcccgggagtttgagaccagcctgcacaacatagtaaaaccttactcaacaacaacaaaaaataaaaaattagccaggcttggtggt

SEQ ID NO: 443255 - DNA, 1778 bp, Homo sapiens
aaaaaaaaaaaaagaaaagaaaagacacatttgataaaggactgttattcaaaataaacaactctcaaacctcaacaataagaaaacaaagaacctgactttaagaacaggacaatgaccttaacggacacctcactaaagaagatataaagatggcgagtatgcatatgaaaaaaagtcacataatcaggaaaatgcaaattaaaacaataccactacacacctattagaatggccaaaacccattaacagtgacaatatcaaatgctggtgagaatgtgaacagaaactcccattcattactggtgggaatataaaatggtaccatcactttgaaagacagtttagaggtttcttgcaaaactaaaggtattcttaccatatgatccagcaactgtgttccttgctatttacccaaacgaactgaaaacttatgtccacacaaaagacacgcacacagatgtttgatgtttatagcagctttattcacgattgccaaaactagggagcaaccaagatgtccttcagtaagtaaatggacaaataaacccgggtatatccagataatagaatagtcaagtgcaaaagaaaaaaaaaagctgtcaaaccgtgaaaagccattgaggaaatcgtaaacgcatattagtacgtgaaaaaagaaaatctgaaaaggctatagactgtatgattccaactatgacatcttgaaaaggcaaaactatggagacagttaacaaaaaatagtggttgccagtggctggggaagagaagggatggcgagggggagcacagagtatttcagggcagataaacattgtaccgctacaacagtggatatgtgccatacaattggccaaacccatagaacatacaaacagcaagagtaaaccttggccgggcgcagtggctcacgcctgtaatcccaacactttgggaggccgaggtgggtggatcacctgaggtcaggagctcgagaccagcctggccaacatggtgaagccccatctctatcaaaaatacaaaaatttagctgggcgtggtggtgggcacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaaccctaatgtaaaccatggactttgggtggtaaagatgtctgaatgtaggtccatcaattttaacaaatgtaccactttcgtgggggatataatatatcttgataataatataacttgagaaatccttcattttctgataatctaacaaatcacaactctgaacataatttttaatacaaaggcttaggttcatcaagattctcttttaaagaactatctaactgcccaaaatgattcacatacacagtgaacatacaaaatactaaaaggtcaagtccaaaattttgattctctagagaaacgtataaagcagtttaactgggaacatactaagacagaacacaaagtaacggaaatgccactttagctaccaaaagaacaggaagagcaaatactaagactttactttgaaagtctaaggctacttcttcctggtagggctctaacctcttgccaagaagcctgtaagtttatttttcttacttctttattttaagtgagaaaccatgaaattaaccatttcagagctgaagaaaacaaaggagaaacaactatgtctacggtgaactttcacattaactattctaaa

SEQ ID NO: 443256 - DNA, 1105 bp, Homo sapiens
tcgagatgggagtctttttctgtcgccaggctggagtgcagtggtgcagtctcggctcactgcaacctctgcctcgcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443257 - DNA, 3200 bp, Homo sapiens
  misc_feature (1483)..(1483): n is a, c, g, or t
aaactctggacttcaagtgatcacctgcctcagccttctaaggtgctaggattataggcttgagccactgcagccaccactctgtatatctcttttgaaagtcataagcaatatctttggaaaaaacacttaaggttatttatttagaggtaagtgtctctctgtacccccagctggagtacagtggcacagtatcacagcttgctgcagcatcaaattcctaggctcaagccatccttccaccggacatgttggcgtgcacctcctgagtagctgggactacagttgtgctctaccacaccgggctaatttttgtattttttagtagagacagggttttgccatgttggacaggctggtctggaacacctgacctccggtgatctgcccacctcagtctcccaaagggctgggattaaaggcatgagccaccgcactcagccacttaaggcttttaaaaaatcaattaatttctaaatggttttggacttttgactccttataagtgttaagatattttggtatcacttttttccttccaaaaaaaaaaaaaaaaccaactaggtgatatctattcctcagtcaaagttaattaaaactattttggatcccagcactttgggaagccaaaggcaggcagatcacctgaggtcaggagttcaagaccagccttgccaacatggtgaaaccctgtctctactaaaaatacaaaaattagcagagcatggtggcgggcgcctgtaatcccagctactcaggaggctgaggcaggagaattgcttgaacccgggaggtggagtttgcagtgagccaagatagtgccatcgcactccagcctggacaacagagcgagactccatctaaaaaaaaaaaaaaaaaaaaaaaaaactcagtttttggttttgaaaatgtcatgatacctgttgagataactgctgaatagatgggtaatacacagtctagggcatggtatcaaaagaacttgtcactgtacatatcggaaatggtaaaaatatgttttgccgttttcacgaattcattcatttttcatgtttcatgaattcattctttttaaaaaaaaaaaaaatcctgctaattctctgtttctcttgcttttctcctttatgactaagttttcctcattatgggttaccccacattactgcttacgaagacatctctttagtcagaaaacagtagcttggttcagttctagcttcattgttaagctcataggtaaatctggcaaatggctagaaacagtcacatgtttgcttgtccttaatgctctcaccttttcccagctatttggatgtatatacttttgcttactttgtagtgtaccaacttaatatatgttatagactaaatgtttatgtcctcccaaacttcatattttggaagccagacatggtaactcacacctgtaaacctaacactttgggaggcctagttgggaggattgcttgagtccgggagttcngaaccagcctggacaacatggtgagaccccgtctctacaaaaaaaaaaaaaaatttttaattagccaggtgtggtggcatacacctgtagtcccagctactcaggaggcttgcctgagcccagaagtttgagactgcagtgagccatgatattgccagcctgggtgacagagcaagaccttgtctcaagaaaaaaaaaaaaaaattgccaattgcgatggctcacgcctgtaatcccagcactaggaggccgaggtgggtgaatcacctgaggtcaggagttttgagaccagcctggccaacgtggcaaaaccccgtctctactaaaaatgcaaaaattaccgggacgtgttggtgagcacctgtaatccctgctactcgggaggctgaggcaagagaatctcttgaacccagggggtggaggttgcactgagccgagatcatgccattgtacttcacctgggcaacaagagggaaactgtctccaaaaaaaaaaaatttggagggctgggcacggtggctcacacctgtaatcccagcactttgggaggccaaggcggtggatcacaaagtcaggagttcaagaccagcctggccaacatagtgaaaccctgtctctactaaaaatacaaaaattagccaggcatggtggcacacgcctgtagtcccagctactggggaggctgaggcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443258 - DNA, 2928 bp, Homo sapiens
  misc_feature (1211)..(1211): n is a, c, g, or t
ttaggctgtagaatgtagacaagtaaataggcatcatcagtatgatgagagtgaagctacttaatactgtggaatcaaataaaggaggaaccccttactaaaccaagagggaggaataaaatggaatgggactagagaagcaattagctttaataagggtattatggaagactttctagatgagaagcagtaagtacagatgtttggaggcaaacattagagagattgttgggtaaagaagacaatgctggaggtctacttgtgaaggccttgaatgctatgtgcagaagtcagcttctgagaaccaggaagaagatattgaaagattttaagtagaagaatcataggattgaattcattttagacagatcacctgaggtcaggagttcaagaccagccttgccaacatggtgaaaccctgtctctactaaaaatacaaaaattagcagagcatggtggcgggcgcctgtaatcccagctactcaggaggctgaggcaggagaattgcttgaacccgggaggtggagtttgcagtgagccaagatagtgccatcgcactccagcctggacaacagagcgagactccatctaaaaaaaaaaaaaaaaaaaaaaaaaactcagtttttggttttgaaaatgtcatgatacctgttgagataactgctgaatagatgggtaatacacagtctagggcatggtatcaaaagaacttgtcactgtacatatcggaaatggtaaaaatatgttttgccgttttcacgaattcattcatttttcatgtttcatgaattcattctttttaaaaaaaaaaaaaatcctgctaattctctgtttctcttgcttttctcctttatgactaagttttcctcattatgggttaccccacattactgcttacgaagacatctctttagtcagaaaacagtagcttggttcagttctagcttcattgttaagctcataggtaaatctggcaaatggctagaaacagtcacatgtttgcttgtccttaatgctctcaccttttcccagctatttggatgtatatacttttgcttactttgtagtgtaccaacttaatatatgttatagactaaatgtttatgtcctcccaaacttcatattttggaagccagacatggtaactcacacctgtaaacctaacactttgggaggcctagttgggaggattgcttgagtccgggagttcngaaccagcctggacaacatggtgagaccccgtctctacaaaaaaaaaaaaaaatttttaattagccaggtgtggtggcatacacctgtagtcccagctactcaggaggcttgcctgagcccagaagtttgagactgcagtgagccatgatattgccagcctgggtgacagagcaagaccttgtctcaagaaaaaaaaaaaaaaattgccaattgcgatggctcacgcctgtaatcccagcactaggaggccgaggtgggtgaatcacctgaggtcaggagttttgagaccagcctggccaacgtggcaaaaccccgtctctactaaaaatgcaaaaattaccgggacgtgttggtgagcacctgtaatccctgctactcgggaggctgaggcaagagaatctcttgaacccagggggtggaggttgcactgagccgagatcatgccattgtacttcacctgggcaacaagagggaaactgtctccaaaaaaaaaaaatttggagggctgggcacggtggctcacacctgtaatcccagcactttgggaggccaaggcggtggatcacaaagtcaggagttcaagaccagcctggccaacatagtgaaaccctgtctctactaaaaatacaaaaattagccaggcatggtggcacacgcctgtagtcccagctactggggaggctgaggcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443259 - DNA, 3007 bp, Homo sapiens
  misc_feature (1290)..(1290): n is a, c, g, or t
agccgagattgcgccactgcactccagcctgggcgactgaacgagactccgcctcaaaaaaaaagagtttgtgaggaaaattaaaagctgattggataaagtgttactctggggaaaagagagcaaacttttggtggttggttgatcagagatggcctcactgagaaggtattagaaaggacaagaacagtgtgagaccaaagggaatagctgggcaaaggccctaaggtgaaaaatttgttgtgtttagggaatagcaaggtcagtgtatccgaaatctagtgaccaaaagaaggaatgataggaggtgaagtcttcagcctcaataagaaggtgaagtgcactggaagccattgaaggatttaagaaatggagtatctggccgggcgcggtggctcacgcctgtaatcccagcactttgggaggccgaggtgggaggatcaagaggtcaggagatggagaccatcctggctaacatggtgaaaccccgtctctattcaaaataaaaaatttttttaaaaattagccaggcgtggtggcgggcgcctgtagtcccagctactcgggaggctgaggcaggataatggcgtgaacccaggaggcagggcttgcagtgagccgagatcgtgccactgcactccagcctgggcgacagagcgagactccgtctaaaaaaaaaaaaaaaaaaaaaaaaactcagtttttggttttgaaaatgtcatgatacctgttgagataactgctgaatagatgggtaatacacagtctagggcatggtatcaaaagaacttgtcactgtacatatcggaaatggtaaaaatatgttttgccgttttcacgaattcattcatttttcatgtttcatgaattcattctttttaaaaaaaaaaaaaatcctgctaattctctgtttctcttgcttttctcctttatgactaagttttcctcattatgggttaccccacattactgcttacgaagacatctctttagtcagaaaacagtagcttggttcagttctagcttcattgttaagctcataggtaaatctggcaaatggctagaaacagtcacatgtttgcttgtccttaatgctctcaccttttcccagctatttggatgtatatacttttgcttactttgtagtgtaccaacttaatatatgttatagactaaatgtttatgtcctcccaaacttcatattttggaagccagacatggtaactcacacctgtaaacctaacactttgggaggcctagttgggaggattgcttgagtccgggagttcngaaccagcctggacaacatggtgagaccccgtctctacaaaaaaaaaaaaaaatttttaattagccaggtgtggtggcatacacctgtagtcccagctactcaggaggcttgcctgagcccagaagtttgagactgcagtgagccatgatattgccagcctgggtgacagagcaagaccttgtctcaagaaaaaaaaaaaaaaattgccaattgcgatggctcacgcctgtaatcccagcactaggaggccgaggtgggtgaatcacctgaggtcaggagttttgagaccagcctggccaacgtggcaaaaccccgtctctactaaaaatgcaaaaattaccgggacgtgttggtgagcacctgtaatccctgctactcgggaggctgaggcaagagaatctcttgaacccagggggtggaggttgcactgagccgagatcatgccattgtacttcacctgggcaacaagagggaaactgtctccaaaaaaaaaaaatttggagggctgggcacggtggctcacacctgtaatcccagcactttgggaggccaaggcggtggatcacaaagtcaggagttcaagaccagcctggccaacatagtgaaaccctgtctctactaaaaatacaaaaattagccaggcatggtggcacacgcctgtagtcccagctactggggaggctgaggcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443260 - DNA, 3008 bp, Homo sapiens
  misc_feature (1291)..(1291): n is a, c, g, or t
agccgagattgcgccactgcactccagcctgggcgactgaacgagactccgcctcaaaaaaaaagagtttgtgaggaaaattaaaagctgattggataaagtgttactctggggaaaagagagcaaacttttggtggttggttgatcagagatggcctcactgagaaggtattagaaaggacaagaacagtgtgagaccaaagggaatagctgggcaaaggccctaaggtgaaaaatttgttgtgtttagggaatagcaaggtcagtgtatccgaaatctagtgaccaaaagaaggaatgataggaggtgaagtcttcagcctcaataagaaggtgaagtgcactggaagccattgaaggatttaagaaatggagtatctggccgggcgcggtggctcacgcctgtaatcccagcactttgggaggccgaggtgggaggatcaagaggtcaggagatggagaccatcctggctaacatggtgaaaccccgtctctattcaaaataaaaaatttttttaaaaattagccaggcgtggtggcgggcgcctgtagtcccagctactcgggaggctgaggcaggataatggcgtgaacccaggaggcagggcttgcagtgagccgagatcgtgccactgcactccagcctggacaacagagcgagactccatctaaaaaaaaaaaaaaaaaaaaaaaaaactcagtttttggttttgaaaatgtcatgatacctgttgagataactgctgaatagatgggtaatacacagtctagggcatggtatcaaaagaacttgtcactgtacatatcggaaatggtaaaaatatgttttgccgttttcacgaattcattcatttttcatgtttcatgaattcattctttttaaaaaaaaaaaaaatcctgctaattctctgtttctcttgcttttctcctttatgactaagttttcctcattatgggttaccccacattactgcttacgaagacatctctttagtcagaaaacagtagcttggttcagttctagcttcattgttaagctcataggtaaatctggcaaatggctagaaacagtcacatgtttgcttgtccttaatgctctcaccttttcccagctatttggatgtatatacttttgcttactttgtagtgtaccaacttaatatatgttatagactaaatgtttatgtcctcccaaacttcatattttggaagccagacatggtaactcacacctgtaaacctaacactttgggaggcctagttgggaggattgcttgagtccgggagttcngaaccagcctggacaacatggtgagaccccgtctctacaaaaaaaaaaaaaaatttttaattagccaggtgtggtggcatacacctgtagtcccagctactcaggaggcttgcctgagcccagaagtttgagactgcagtgagccatgatattgccagcctgggtgacagagcaagaccttgtctcaagaaaaaaaaaaaaaaattgccaattgcgatggctcacgcctgtaatcccagcactaggaggccgaggtgggtgaatcacctgaggtcaggagttttgagaccagcctggccaacgtggcaaaaccccgtctctactaaaaatgcaaaaattaccgggacgtgttggtgagcacctgtaatccctgctactcgggaggctgaggcaagagaatctcttgaacccagggggtggaggttgcactgagccgagatcatgccattgtacttcacctgggcaacaagagggaaactgtctccaaaaaaaaaaaatttggagggctgggcacggtggctcacacctgtaatcccagcactttgggaggccaaggcggtggatcacaaagtcaggagttcaagaccagcctggccaacatagtgaaaccctgtctctactaaaaatacaaaaattagccaggcatggtggcacacgcctgtagtcccagctactggggaggctgaggcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443261 - DNA, 2209 bp, Homo sapiens
  misc_feature (492)..(492): n is a, c, g, or t
agccgagattgcgccactgcactccagcctgggcgactgaacgagactccgcctcaaaaaaaaagagtttgtgaggaaaattaaaagctgattggataaagtgttactctggggaaaagagagcaaacttttggtggttggttgatcagagatggcctcactgagaaggtattagaaaggacaagaacagtgtgagaccaaagggaatagctgggcaaaggccctaaggtgaaaaatttgttgtgtttagggaatagcaaggtcagtgtatccgaaatctagtgaccaaaagaaggaatgataggaggtgaagtcttcagcctcaataagaaggtgaagtgcactggaagccattgaaggatttaagaaatggatatcatggactaggatagtagcagtagagatgagggaagtggatggatccaaaaagctgacctatcttgcttaccaattaaatgaggaaagggaggattgcttgagtccgggagttcngaaccagcctggacaacatggtgagaccccgtctctacaaaaaaaaaaaaaaatttttaattagccaggtgtggtggcatacacctgtagtcccagctactcaggaggcttgcctgagcccagaagtttgagactgcagtgagccatgatattgccagcctgggtgacagagcaagaccttgtctcaagaaaaaaaaaaaaaaattgccaattgcgatggctcacgcctgtaatcccagcactaggaggccgaggtgggtgaatcacctgaggtcaggagttttgagaccagcctggccaacgtggcaaaaccccgtctctactaaaaatgcaaaaattaccgggacgtgttggtgagcacctgtaatccctgctactcgggaggctgaggcaagagaatctcttgaacccagggggtggaggttgcactgagccgagatcatgccattgtacttcacctgggcaacaagagggaaactgtctccaaaaaaaaaaaatttggagggctgggcacggtggctcacacctgtaatcccagcactttgggaggccaaggcggtggatcacaaagtcaggagttcaagaccagcctggccaacatagtgaaaccctgtctctactaaaaatacaaaaattagccaggcatggtggcacacgcctgtagtcccagctactggggaggctgaggcaggagaattgctttgaacccgggaggcagaggttgtgagctgagatcgcgtcagtacactccagcctgggcaacaatgcgagattgcatctcaaaaaaataaataaatatttggagtcccataataaataaatatttggagtccaatgtgatagtatctggagatggggcctttggaggtaatatgggttagataggtcatgacggtagggccctcattatgggattagtggcgttataagaagaagagagaaatcttcctcctcaagagcagaggaaaagccatataagaatacagtgagacggccacttccaaaccagaaagggagcccccaccaggaaccaaattggctggcaccttgatcttggacttcccatgctccagaactgtgagaaataaatttctattatttaagcccatggtagttttatggcatcctaagctaagacagcgcgtctctagtttcccacagattcataaaggtccatacaaaaatgttataactgttaatagtgtcctgtccttgaatttaacagcaaccaacatattgtttgcatagttcttgcaccatttggaaacagtgacctttaggtgttgcaggtaactattgggaaatccttcaatttgtttaacatttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctctactaaaaatacaaaaattagtcgggcgtgctggtgcatgcctgtaatcctagctgcttgggtgctgagtcaggagaattgcttgaacccgggaggtggaggttgcagtgagccaagatcgtgtcactgcactccagccggggcaacagagcgagactctgcctcaaaaaaagaaaaaagaaatcagaggctggg

SEQ ID NO: 443262 - DNA, 1807 bp, Homo sapiens
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443263 - DNA, 1663 bp, Homo sapiens
tggcacgaggcccgcccggccgcgatggcgggtgaaggtggttcctccgggcaaggtggagttggcgagacgccggcccggagccctggggccggttggcgggtgtggcctgcggggtccctcttggggtacatgtctgttgcttactaagtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443264 - DNA, 1679 bp, Homo sapiens
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatgcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443265 - DNA, 1194 bp, Homo sapiens
  misc_feature (54)..(55): n is a, c, g, or t
taccgcgtccccatcgttctacctttctacctattcgccgccacggggtgtcannagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443266 - DNA, 1227 bp, Homo sapiens
agcggcttgttagtctctttaagagatactgagaaaaaatgcttttgttgatatctttttgtgttgtttgctttttaatgtctttaagtttttgaagggtcccagccaattatctttagaatgtcccacccaactttggatttgtctgtttcctcagaattagatttacctgaatttatcatgttaaacatttttcacagtgataccacatctgtgatgttgtgtaattatgctaacaccgtatcaaaaggcacctaatgccaacataaagtttatgatatataaatttgtaattggcagcaacaaagacttaattgcttgaatcattttttcctttttcaaatagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443267 - DNA, 1023 bp, Homo sapiens
  misc_feature (40)..(40): n is a, c, g, or t
tggggtgacttaaggatgtaggcactgcttggatgggatngcaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443268 - DNA, 1008 bp, Homo sapiens
gaaagaagtaatactttcacatacagcaacagaatttttatcagaatatattgtaaccctcaggtttctgttttgggtgatacatactgcaacatttgaactttctccatgtccacatttcctgttcaggggacaaaacatgtttaaaatccatttaatgcactaaggattctcaaaaggcaccagattattttttcttcaactgttttgacttttattgttgttgggtttctttcttggaatagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443269 - DNA, 1440 bp, Homo sapiens
  misc_feature (1282)..(1282): n is a, c, g, or t
  misc_feature (1285)..(1285): n is a, c, g, or t
  misc_feature (1288)..(1288): n is a, c, g, or t
  misc_feature (1346)..(1346): n is a, c, g, or t
  misc_feature (1411)..(1411): n is a, c, g, or t
  misc_feature (1431)..(1431): n is a, c, g, or t
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaacgnttntgnttaatctgagaatcacatttggtttgttgagcctaatatttgttgagattttgcaggnccctgatcttttgtggtcctgtaaaagatactgaggaatgtctttcagccaagccaagaggatgntttcaataaacctaataatntgaagttca

SEQ ID NO: 443270 - DNA, 574 bp, Homo sapiens
ccttgataacacaagtagtcgtatgtttatatgtttacagtttttcttatgagaaaaaaatggctgtgcgaatatctagggagaggatgcaataatgtagaaaaaaattaattttatatttgctttatgtttatggaaagataagtttaataaaaataagaaaatatatgtgatgtcctttcagaaacttctagagggatatttaaaactttcatctcttcatgtgaggtattccattataatgttgttcatttttaataacaaataatttatatcattacagacagatttgaccagttttgggccatcaatcggaaactcatggaatatcctgcagaagaaaatggatttcgttatatcccctttagaatatatcaggtaggaaataacattttaaaaaacatccatttatgaaagcctcagacatcttaattgaagcactctagtgtagaactctttgtctgcatagtaactaaacggtatttattaggggttttccaaactgtgtctttcagtggcaatcaagtcagataccgcactgaaatatttgactcatatgcatttggtactcatt

SEQ ID NO: 443271 - DNA, 3311 bp, Homo sapiens
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaatgttgtgtccgtctttatttaaaacaagttacctgttgataaaatcattaaaatttccttagtcac

SEQ ID NO: 443272 - DNA, 486 bp, Homo sapiens
  misc_feature (40)..(40): n is a, c, g, or t
tggggtgacttaaggatgtaggcactgcttggatgggatngcaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaaggtaatacaatcagcaacattaaaacatttctttcattttctgttactgaagtaaaataagcattccacatttataaacaacaggttatttcaggaagatattttcatatcttacagcgaaaagtcttttcaaacagaagcacctaatatttaatatattattttgtaaattattgactaacaaaatgatgactcgactggcgaaataaaatacagtttttaaatca

SEQ ID NO: 443273 - DNA, 872 bp, Homo sapiens
tcaggaccgcgacaagccagcccagatccgcttcagcaacatttccgccgccaaagcggttgctgatgctattagaacaagccttggaccaaaaggaatggataaaatgatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataaca

SEQ ID NO: 443274 - DNA, 1270 bp, Homo sapiens
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaaggtaatacaatcagcaacattaaaacatttctttcattttctgttactgaagtaaaataagcattccacatttataaacaacaggttatttcaggaagatattttcatatcttacagcgaaaagtcttttcaaacagaagcacctaatatttaatatattattttgtaaattattgactaacaaaatgatgactcgactggcgaaataaaatacagtttttaaatca

SEQ ID NO: 443275 - DNA, 1153 bp, Homo sapiens
ccgggagctgcagactacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagcaaaaaaaaaaaaaaaaaaaaaaaaaaaaaaaaaaaaaaaaaaaaacaaaaaaaaaaaaaaaaaaaaaaaaaaaaagaacaaaaaggagggggggggcgcccaaaaagaaaatactcgcccagggagaggccaccacaataatgaccgcaccacaccttgttggcagacaaggaggcgcccccacaagagtgaggtgaataacaacaaccgcgccggcgggcccgttataaaaaacgcagaggggggaaggaaacacagcgcgcggaaccatgggggaaacacccaaatccgcgggcgggcaccacacggcggacaacccaa

SEQ ID NO: 443276 - DNA, 770 bp, Homo sapiens
ccgggagctgcagactacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaaaaaaaaaaaaacttcgagagaatagtttctctctctcctcggggtcgccgctgtgcgaaggggggccgccggccaatgttctgtggcggcattcttggcaagtgggatgggtcggtggcgggaacgtggcgtccaagtttccgtggatcaaggagggaataaggcaagaccttacaggcattggagcccaaataacttggaagggcccggcaaattccttccggcgtaacaaccgggacgtggattctcaccggcaaagagactggtgggcgcgtggagacgccgggcaagccgagacgggccaaagggtggtcgggcggtgggctcattaagcgcgggagtatccgggccacggggaaggccttggcgcaccttccttttggtggcgggaccaaccgttctaactaaggattggttctgcggccacggcttcagcaagctttcggaccacttggatcgggatagaccaagtgtccggccccggactggggcttggga

SEQ ID NO: 443277 - DNA, 716 bp, Homo sapiens
cgctaccagctccccgctgccctgcgctcggcgggctggcatccggcccgggggaaagcggaccaggtaagggccccggggcccgcgcgccctggctaggccagcagaggctcaccgacccccccgacgagcgcagaacagcgcaggggatccccgccagctttctccacaccccaacattcttgggaacatagtggtcccctggggtggggaagcagtggcggctggggctccaggggcagcagagcaaccaagagcgatggaaaaccattcccgagtccttgcaggaaaacggtgaacaccacggggggcgaggcggccgagggtgggagcggggggcgggagacgcggggcgctggcagtgaggagggccctaggcggagaaggagctagcgttccgctgcagcagccccccctccccacaccccagcccttctgcaggtctgcggggccaagtgtcccggcggcgcacctcgtggcgagaatcgggagaaggaggagactacaaggataggcccaggtcagtgcgagggacggtggtgggggcgggtgcagagtccagtctgaggtcccctcccaactcccccatctcccgtcctccattttggtgcctgccgagatctagggatggatctgtagggaaaatggtgggtttgggggcaggtaggggaagacacgagaggtgggggggggggcgggctcgaatgggggccccc

SEQ ID NO: 443278 - DNA, 834 bp, Homo sapiens
ccgggagctgcagactacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagcaa

SEQ ID NO: 443279 - DNA, 377 bp, Homo sapiens
gttgaggtgatatttgtgagttttctatgctagctgtgatttaggacagtgcttctgaaatattattctgtacaaaaatcacctggggatattgttagaatgcagaatctgattccagaagtctagggaaggcccagagattctagattttgaagaaactttccatgtcaatgaccacacattgagtagcatgagaagagaatcctttgtttcagcactcaattctccttctgcctcagacttgaaaaggaagaatatcaataggtggttcttgtcttttgtattccatgaagttgctatttaaaattgcatctttgtgcattgccaccccatatgtaatatttagagggaagaaaccttgttactaataagaaaag

SEQ ID NO: 443280 - DNA, 470 bp, Homo sapiens
aaacattgcaccaagagttatatgtgcattctcgtatttaatgcttgactgtcccctcttggaagcctgtggttccatccaatcacttttgccagggaattgaggatctagggatatgttgagcacttgagtagaggtgatactcaggattggcactccacttctatcactgatctgattctctgactcgtctgtcaaaagagaaggggttatcctagctcagaggtcttcagccagagaactgcatccaaaatctgtggtctagataatacctaagataacgaccaggtcaaatattacatgactgattgaggcctatggaagggaacatagtacagtgatttagagcccatggtcagagggccctgtgtgcatgcctccaccagatcttagctgtgcaatcttgggtaaattactgtacctctctaagcctcacttttctcattattaaaatggggatacaaattcta

SEQ ID NO: 443281 - DNA, 585 bp, Homo sapiens
aaacattgcaccaagagttatatgtgcattctcgtatttaatgcttgactgtcccctcttggaagcctgtggttccatccaatcacttttgccagggaattgaggatctagggatatgttgagcacttgagtagaggtgatactcaggattggcactccacttctatcactgatctgattctctgactcgtctgtcaaaagagaaggggttatcctagctcagaggtcttcagccagagaactgcatccaaaatctgtggtctagataatacctaagataacgaccaggtcaaatattacatgactgattgaggcctatggaagggaacatagtacagtgatttagagcccatggtcagagggccctgtgtgcatgcctccaccagatcttagctgtgcaatcttgggtaaattactgtacctctctaagcctcacttttctcattattaaaatggggatacaaattctacccactgcctggactaaatgagttaatattatacttccaaagtgtttggcaatgcttggtatattttaaaagttccttaaatattatcgaatagtactgctaatattcttatgtg

SEQ ID NO: 443282 - DNA, 229 bp, Homo sapiens
ccatgggcatggggcggggccgtcagcgggggcgtggtcggggtgtcgcgcgggaacccgcgcgggaggagagcggggattccggaactagagtgtgggagccagaggccgtagcgggcagggctcgagcactggagtagagcagtccgacaggtagagaagtgagactggctgcggcacagggcgggttagggctccaggcagggcttgagcgggacgagggggcggg

SEQ ID NO: 443283 - DNA, 798 bp, Homo sapiens
ccatgggcatggggcggggccgtcagcgggggcgtggtcggggtgtcgcgcgggaacccgcgcgggaggagagcggggattccggaactagagtgtgggagccagaggccgtagcgggcagggctcgagcactggagtagagcagtccgacagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggc

SEQ ID NO: 443284 - DNA, 990 bp, Homo sapiens
gcggggtagcacctccgcctgtcggtggtggggcggaggctggagggggtgggcctaggatgcggaggcggcagctcgcgtgggggcgtgaccatgctggcgggggcggggccggaggcgggcggtttagagagcggggcggtctgcggggtgggggcggggcctggtgggggcggggcctgtgcggtctgcggcgcggagccgagtgggctgcggggatgcgggggaccagctgcgtgggcggcggcgccgagagccccggaggcgcggggctgagcgagggcccgcgggggcgctggctgcgcttggctccggtatgcgcctacttcctctgcgtctcgctagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggc

SEQ ID NO: 443285 - DNA, 721 bp, Homo sapiens
ccatgggcatggggcggggccgtcagcgggggcgtggtcggggtgtcgcgcgggaacccgcgcgggaggagagcggggattccggaactagagtgtgggagccagaggccgtagcgggcagggctcgagcactggagtagagcagtccgacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggc

SEQ ID NO: 443286 - DNA, 824 bp, Homo sapiens
ccatgggcatggggcggggccgtcagcgggggcgtggtcggggtgtcgcgcgggaacccgcgcgggaggagagcggggattccggaactagagtgtgggagccagaggccgtagcgggcagggctcgagcactggagtagagcagtccgacagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggctgcctcgtgctgtgtcaaaatgtcct

SEQ ID NO: 443287 - DNA, 940 bp, Homo sapiens
gcggggtagcacctccgcctgtcggtggtggggcggaggctggagggggtgggcctaggatgcggaggcggcagctcgcgtgggggcgtgaccatgctggcgggggcggggccggaggcgggcggtttagagagcggggcggtctgcggggtgggggcggggcctggtgggggcggggcctgtgcggtctgcggcgcggagccgagtgggctgcggggatgcgggggaccagctgcgtgggcggcggcgccgagagccccggaggcgcggggctgagcgagggcccgcgggggcgctggctgcgcttggctccggtatgcgcctacttcctctgcgtctcgctagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtcggggctagctcgggctgtcggggctagtcgggggcctgtctgggctagtcaggggctgtcggggctagtcggggcctgtcgggccttagtcggggccttgtc

SEQ ID NO: 443288 - DNA, 884 bp, Homo sapiens
ccatgggcatggggcggggccgtcagcgggggcgtggtcggggtgtcgcgcgggaacccgcgcgggaggagagcggggattccggaactagagtgtgggagccagaggccgtagcgggcagggctcgagcactggagtagagcagtccgacagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggcaaagaagaaacagacacacaagaagaaaacacaaacacgggggggccacaaaatacccgcggggccacactaagaccacgttttgg

SEQ ID NO: 443289 - DNA, 809 bp, Homo sapiens
gcggggtagcacctccgcctgtcggtggtggggcggaggctggagggggtgggcctaggatgcggaggcggcagctcgcgtgggggcgtgaccatgctggcgggggcggggccggaggcgggcggtttagagagcggggcggtctgcggggtgggggcggggcctggtgggggcggggcctgtgcggtctgcggcgcggagccgagtgggctgcggggatgcgggggaccagctgcgtgggcggcggcgccgagagccccggaggcgcggggctgagcgagggcccgcgggggcgctggctgcgcttggctccggtatgcgcctacttcctctgcgtctcgctagctgccgtgctgctcgccgtgtactacggtctcatctgggtacccacgcggtctcccgcggcacccgccggcccacagcccagcgcgccgtcccctccgtgtgctgcccgcccgggcgtgccgcctgtcccggcgcccgccgctgcctccctctcctgcctcctgggagtccccggcgggccgcgaccccagctccagctgccgctgagccgccgccgccgctacagcgaccctgaccgccgtccgagccgccagacacccagagagacgccagaggccgcggaggggccttgcctcttgcagctactctgtggtcaggccgggtcctccaccatcaggaagatcccatcctgagctctgtctcctgcccctcctgctgtgggatgctgagcacagagcccacagcccatctgcctcttcacctccctgaatccgtgtccatctgcaataaacgacagcctcggc

SEQ ID NO: 443290 - DNA, 1639 bp, Homo sapiens
ggcacgaggcccatggaggatatgtaccgtattttctctgatccgtatatgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 443291 - DNA, 565 bp, Homo sapiens
  misc_feature (4)..(4): n is a, c, g, or t
  misc_feature (71)..(71): n is a, c, g, or t
gacncggactgggacccctggggattttattacttatcctccccaggccccaccagctggctgggaggtgngttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 443292 - DNA, 639 bp, Homo sapiens
  misc_feature (7)..(7): n is a, c, g, or t
  misc_feature (570)..(570): n is a, c, g, or t
  misc_feature (573)..(573): n is a, c, g, or t
  misc_feature (575)..(576): n is a, c, g, or t
  misc_feature (582)..(582): n is a, c, g, or t
  misc_feature (596)..(596): n is a, c, g, or t
  misc_feature (601)..(601): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (625)..(625): n is a, c, g, or t
  misc_feature (627)..(628): n is a, c, g, or t
  misc_feature (634)..(634): n is a, c, g, or t
tgttatncctttcaacagtctgcattctcacatgggtgctgttatctgtccagccactccgtgagtgaaccgagacagatgagcatcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatncgncnnagaagnctgtttctgcccantagtnantgnggccgngtggacatgttcngnngccatnaaaaa

SEQ ID NO: 443293 - DNA, 901 bp, Homo sapiens
  misc_feature (568)..(568): n is a, c, g, or t
  misc_feature (845)..(845): n is a, c, g, or t
ggaagtgcagaggcaaatgcatttagtgttcttcagcatgtcctcggtgctgggccacatgtcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcccatttgatgtttctgcatttaatgcagttaatcagattctgnatctttgggattaataattatttcgcaggccaaagtgtggaagatgttatcaggtgctatattcaagttaaacaatagtcaagggaactttccagacagattgtcaaggtggcaagaacaagtgaagggtggtactaaggagggagctcagagtgtctgggagagtcgggcccaggcatatttgtggtttaatgaacaaacaagcttagagatggtacggaagggattataaggggagaatgttttgcaattagggagggatggacaccctgggagngatagggcctagaggggtctcacggagagacttattttgaagaagccgaattgaaa

SEQ ID NO: 443294 - DNA, 1966 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443295 - DNA, 1938 bp, Homo sapiens
ggcacgaggcccatggaggatatgtaccgtattttctctgatccgtatatgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443296 - DNA, 1665 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgacgtcatgctgcttaatagtctttcttacctcttctcaataactaattcacatatctttatatgtgctgct

SEQ ID NO: 443297 - DNA, 1578 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcaccttgcatattcaagggccg

SEQ ID NO: 443298 - DNA, 1908 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443299 - DNA, 1276 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaaaggtgggcagatgagataggggtacc

SEQ ID NO: 443300 - DNA, 1909 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443301 - DNA, 1124 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcactccggccagccattgcactccggccagccattgcactccggccagccattgcactccggccagccata

SEQ ID NO: 443302 - DNA, 1282 bp, Homo sapiens
cagtctgtctagaggaccctgctgtgactatttgttgaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443303 - DNA, 766 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggaggtaccaataaaacatattttgaaatgtg

SEQ ID NO: 443304 - DNA, 2202 bp, Homo sapiens
ccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtcttcacactgtagcagccaaaaggtaggtttacaatatacactgtccccaacttgccatggatcaattataatttttcaacttgactatggaggaaaaccatcgcaatttcagcttccagtcatgggtcacataacgatggggatacattctgagaaatgtggtgttaggtggtttcatcactgtgtgaacctcagtgttcagacaaatccagatggtatagcctactacacacatgggctctatggtatagtctattgctcttaggctacaaacctgtatagcatgtactatagtactgaatactgtaggcagttataacacaaaggtaagtatttgtgcatctaaacataggaaaggtacagtaaaaatacagcacaaaagataaaaaaatggtatgccatttttatggcatagctcctgctttcgagtgagtcagtgagtgagtggtgagtaaatgggaagggctgggacattactgtgcactgctgtagatactaaacactgtaaacataggctacgctaaatttatttttttaaaattgcactacaacattatgttgtcagtaagtaataggaatctttcagctccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443305 - DNA, 613 bp, Homo sapiens
ccgaaagcagaaatttgtgtgcattataaacaggctgcacaaagcccgtaggcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443306 - DNA, 1565 bp, Homo sapiens
ggcacgaggcccatggaggatatgtaccgtattttctctgatccgtatatgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctccttaattaagtttccccttcaagcctaaattaaacatagctgtcacttggggaaaactcacacatcagggttatatcactgtgggacagtggttattaagaggggtaagggggaacacttaaaaaatcatagcgagggacagaatgcccccagggaaccggtggcgatgtttggagacatatttagttgcaacaacttgtaaggagggtgctattggcatggagaggccagggatgctgctaaacttcgccttacagcaaagaattatctagccccaagtgccagtagtagtacctgtgttgagaaacccccctagatggagatgcagaagaccagacctgggcatggaatgttcttatgctttatgtttacataaatgtgctgtgggctatatcgatttaggctgtaattgcattaaccttccaggtatacctagacacaccagtgattacccttggagggaagcacggttagattggcaaaagaccccaacatttccttctccattctattttgcaacagaaaaagctcagagaaaacagttggagaggcccaaagtaaacaaattgcagtaaacttgaaagcaattatttatgtgtctaattttagcactttatataggagaataaacttagatatatcttgttattagaacaaaataatttagaagattgcatgacagttactaggataatttgctgatttgaatgggacgattaagaagcacattaccgagcggagcgcgatggctcacacctgtaatcctagcactttgggagtcagaggcaggcggatcacttgagatgaggagttcgaaaccagtctggccatcatggtgaaaccccgtctctactaaaaatac

SEQ ID NO: 443307 - DNA, 456 bp, Homo sapiens
gcctggtagcatgcacctgtagtcccagcttcttgggaggctggggcaggaggattgtgtataaacagctgctttatgaacataggaagaataaggaacccatagtgatgacagcattccgcatggacactgtgctgtttgtctggaactaaccttccatctgtgtttttgcctcagtaaagaagtgtgtcagtgctgcaggagactctggtactgaccacagatgaccaacttttcttatctgtcctaggttatcaaggctgcctataatcaagtaaaaacaatagctcaaggaaacctttccaacacagatgtccaagctgccaaaagtaagtctcagtattaactgtgttttatgtttttgttatttgaaagttgtattcttttcagattataacaatattacaatctatgctcataaggactgagaagtacagaaaagcgtaaaaagggaaa

SEQ ID NO: 443308 - DNA, 629 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttg

SEQ ID NO: 443309 - DNA, 435 bp, Homo sapiens
cagtctgtctagaggaccctgctgtgactatttgttgaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgataaaatagtcagcagcagggtaccgagc

SEQ ID NO: 443310 - DNA, 1667 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 443311 - DNA, 2105 bp, Homo sapiens
  misc_feature (1764)..(1764): n is a, c, g, or t
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgaaaaaaaaaaaaaaaaaaaaaaaaaaaaaaaaaaaaaaaacaaaggggggggggggcaaaaatttcccccgggggggcccattagcgcgtcacccantttttttgtgtcagaagggggccccaatgaggaggggccgtataaaaaagagcaggcgcgggcgccgcggtttaaacacacgtgtgcggcatggggaacacaccggctcacgcggggaaccttggcgggaaaggaccccttatccactctggcgcgcggggagaccaatagtcgggaccaaatctcccctcgaaaggagatttataagaggtccaaggcggtaattatttaaacctttacgacgagttatcacgcgtgttaacacacacggcaaatatgacctgcgcggcatcgaaaaaattggggctacacgggcaataggctttgggaacatttttcga

SEQ ID NO: 443312 - DNA, 1916 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443313 - DNA, 1617 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtg

SEQ ID NO: 443314 - DNA, 1719 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtccgaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443315 - DNA, 1198 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtccacccactcggagtgggtccctgccaatcagagttacacacgagtctggtgtccgggctcctccgtccaggcaggctcagcttgactcctccagcctagagtcacaggttagacaggaggggcttatggtcactgctctaaccaatcccacttaacaacaccagtattataactacaggcatccttatagggggac

SEQ ID NO: 443316 - DNA, 1375 bp, Homo sapiens
gagaaaggctgcagcttcctgccagacccttacgcagaagcagctgtgattcagttcgtggtatagtatgaggcccgtgtctgatcgaaatcctggtgtaggtgatggactccttccttcgatgtgcttgaaaaattggatgcctgtcgctcgtgccgtaaagtccttgtgggcaactgacgaatgtgttatatgagggtccctacagactatctaggtggccggactcagcatagatcctgatgcaaagccacgcatgacagtgaaagtgtgctaattcccgatggaccttacgctggattatcaatggtcttgggcacctagacatgtcttctgtgactccttgaacagttgactagatttctgttagtcgacgaagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacaaaaaaaaac

SEQ ID NO: 443317 - DNA, 712 bp, Homo sapiens
agtacctcacgaaggggacgtgggaaagtgttagcggggaacgctgggaaactcccggcctccgccaccatcttgcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaatttgcatgcgcactgctggagatgtatcaggctgcctatatcagtaaccatagtccagga

SEQ ID NO: 443318 - DNA, 1521 bp, Homo sapiens
cgaggagtgggggtgaccttggggttcctaatcctacgtgaccctcctcttctcttctctgcaggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatattacactt

SEQ ID NO: 443319 - DNA, 3001 bp, Homo sapiens
cacgtgggtgcctctgacccggacgcgggtcccgggtggggcggcctcacctcccggccccgcctggtcacgccgcgctccgcccccaggggccgcgccttccagggcgccacagtgggcctggcgcccgtcgagggcatgtgccgcgccgagagctcgggaggcgtgagcacggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggtacgcgggtggggggtcggggctgcggcggggcggctagtcctggggacttcctccgctgcgtttctttggtcgtccctcagtttcctcttctgtaaaatggggataatgatcatagtgtccgcttcagggtggtttatgaggcttaaagggaagaagctcaggcaaagtggattctcaacggtatgaagattattttccgagtaacctggcgaggttactcctacaccgggaggagcaccgtcgggtcgcgattccaccttgggtcccgggctgctcactattggggccgcatcgtcccctgtcccgcttgttgtgtgactttgcgcgggttacttcccctctctgggctctgcgcgtctggcggctgtagccaagcccaggggtggggatcagagaagcgcgggggttgggggactgtccctccatgcccaatgccctccccgtgccggtaggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggagtgccgcgacctctgctgctttgctcacaactgctcgctgcgcccgggggcccagtgcgcccacggggactgctgcgtgcgctgcctgctgaagccggctggagcgctgtgccgccaggccatgggtgactgtgacctccctgagttttgcacgggcacctcctcccactgtcccccagacgtttacctactggacggctcaccctgtgccaggggcagtggctactgctgggatggcgcatgtcccacgctggagcagcagtgccagcagctctgggggcctggctcccacccagctcccgaggcctgtttccaggtggtgaactctgcgggagatgctcatggaaactgcggccaggacagcgagggccacttcctgccctgtgcagggagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtttgcaatagcaaccataactgccactgtgctccaggctgggctccacccttctgtgacaagccaggctttggtggcagcatggacagtggccctgtgcaggctgaaaaccatgacaccttcctgctggccatgctcctcagcgtcctgctgcctctgctcccaggggccggcctggcctggtgttgctaccgactcccaggagcccatctgcagcgatgcagctggggctgcagaagggaccctgcgtgcagtggccccaaagatggcccacacagggaccaccccctgggcggcgttcaccccatggagttgggccccacagccactggacagccctggcccctggaccctgagaactctcatgagcccagcagccaccctgagaagcctctgccagcagtctcgcctgacccccaagcagatcaagtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttcgacccacccactccaggaacccagagccacattagaagttcctgagggctggagaacactgctgggcacactctccagctcaataaaccatcagtcccagaagcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgagtccacactcccctggagcctggctggcctctgcaaacaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatattacactt

SEQ ID NO: 443320 - DNA, 2736 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443321 - DNA, 2594 bp, Homo sapiens
  misc_feature (21)..(21): n is a, c, g, or t
taaagcaggctggtacggccngggattatggatcagccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccaccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443322 - DNA, 627 bp, Homo sapiens
aatcatactacgagcagtggcaagaaaggggctctgcattgtaaccttgacgaccatgactccgtggataagattgtcactcaggaataccatactgtgaatggccacaactgtgaagttagaaaagccctgtcacagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcaaccgtggtggtggtggatatggtggcagtggggatggctataatggatttggtaatgatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443323 - DNA, 583 bp, Homo sapiens
  misc_feature (130)..(130): n is a, c, g, or t
gaattcggcacgaggtttcttgtactgggaccaaagtaaaaatccaagcacattccccttgcagttaggggaggccctactgccttctcaaagcagagaggcagcttatcaaactcagcccaaaactctntttacatgggtggggagatggagcagggaagtacagagtgggatggggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctccctttccagacttgggataactctaagagtcgaccagca

SEQ ID NO: 443324 - DNA, 2705 bp, Homo sapiens
  misc_feature (21)..(21): n is a, c, g, or t
taaagcaggctggtacggccngggattatggatcagccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443325 - DNA, 3084 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccaaaaaaaaaaaagaaaaaaaacaaaaaagggggggggcgctaaaaatatatcccctagggggggcaaaagatgttagagtattcgccaggtttttggacaaaagggggcccataatagggagggattaaaaaaggagggcgaggagcgggtataaacacggtggggagtgggaaaaatggtaaggggaaccttgtgagaggacataaatggggggggggcaatagtggcagaataactgagagatgaaaggctcaaggcagattacagtgtaaacgattaggggtaaacagcggattggtgcgattgagattggatccgattgataggcaattaacagggtgtgtata

SEQ ID NO: 443326 - DNA, 2569 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacgctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443327 - DNA, 2095 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctccctttccagacttgggataactctaagagtcgaccagca

SEQ ID NO: 443328 - DNA, 1767 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcacacttcagcaaatgtaaaaataaaatctaactctcattgacaagcagagtaagaaaagttacatactaataagctgtga

SEQ ID NO: 443329 - DNA, 2277 bp, Homo sapiens
agcggaatgtggtctgtgactatgagtgacggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443330 - DNA, 1740 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgcgctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443331 - DNA, 1694 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443332 - DNA, 1828 bp, Homo sapiens
tctagaggttccaaccaacagtgaagcacattggcaaagttgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443333 - DNA, 1809 bp, Homo sapiens
cgattagggtccaacaacataaccatggaaagtgcacatggatggcaactgcggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443334 - DNA, 1622 bp, Homo sapiens
tgtatgtggcgcgaacaccttggtcgtgtctaccagtgccacatcaatgctcccacattgactcaggacttgacccttcgagaatgtgtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443335 - DNA, 1863 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443336 - DNA, 1224 bp, Homo sapiens
  misc_feature (130)..(130): n is a, c, g, or t
gaattcggcacgaggtttcttgtactgggaccaaagtaaaaatccaagcacattccccttgcagttaggggaggccctactgccttctcaaagcagagaggcagcttatcaaactcagcccaaaactctntttacatgggtggggagatggagcagggaagtacagagtgggatggggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443337 - DNA, 899 bp, Homo sapiens
gatcaaccaagatctggaaagtagaaaggagatgacctacaggccattaagaaggagactgacccagataaaacaaaaagtggattctctcctgaaaaacctggaaaacattgcaacggaacagagcaaacaagcagtagagatgaagaatgataagtcagaagaggagacagagcagcagctccgtgaagacagatgagactaatgtgaagaaggtcctcctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443338 - DNA, 888 bp, Homo sapiens
  misc_feature (21)..(21): n is a, c, g, or t
  misc_feature (864)..(864): n is a, c, g, or t
  misc_feature (874)..(874): n is a, c, g, or t
taaagcaggctggtacggccngggattatggatcagccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaagatggcattgcatgaccttggtggtantctgcaggcncactctgaacatgg

SEQ ID NO: 443339 - DNA, 356 bp, Homo sapiens
gaaatcagtaaatagcctgtgggtgaatgaatgagtgactgaatgatactcttctgttcttcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagaggtgacaggtcccctcactttatcaccccttaccccacccagattctctagccctttccagagcgtggatcctctagtaccc

SEQ ID NO: 443340 - DNA, 2756 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacctgaaaaaaacacacacacag

SEQ ID NO: 443341 - DNA, 2716 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443342 - DNA, 2097 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtcatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443343 - DNA, 2200 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccatatcctgagctgacgtttcaattactttggggaggtggcggggcagggacgggaggaacacgaatagaacacgtcagcatcaggcatctggggcccaatactctgatgcgtccagcaatgtaacctgtatctgccctagtgtacccttcaggcatgaggctgtaccccgttgaccccgacctcctggggcgtttgaaaccagattacccaaactcctgcgttcgcgtcgtgatcacccccgaagctatcttacaaggcaccacagtgtagggcgttcattaccagtgctccaggctgctacctgtacactgacccttatgacccagaggggcattgccctttgtttcccaaggccagggggcgggaaacttcgaggacgcatagcttcccctgccttagggtgcaacacactgcttcctggtggaacggggattaccaggaaggcccccacagctcgtctgcagcgctggcagtttcctccgagagcatttttggatcgcatcaaagttgtgacatttccacccatggaccgc

SEQ ID NO: 443344 - DNA, 2297 bp, Homo sapiens
cactttccgcctggtaaatacaggatatcctgtccagggcaagaatctgatgcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443345 - DNA, 2528 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443346 - DNA, 1811 bp, Homo sapiens
gcatctagagatccacacaataagaatggaagcgtactatgatggcaacgctgcggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443347 - DNA, 1416 bp, Homo sapiens
  misc_feature (130)..(130): n is a, c, g, or t
  misc_feature (189)..(190): n is a, c, g, or t
gaattcggcacgaggtttcttgtactgggaccaaagtaaaaatccaagcacattccccttgcagttaggggaggccctactgccttctcaaagcagagaggcagcttatcaaactcagcccaaaactctntttacatgggtggggagatggagcagggaagtacagagtgggatggtcaggacctgggnnattgcaaccaaaatggggacttcctgggtagggaggtcactccctctactcactgagctaggattagggagggttatagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443348 - DNA, 1486 bp, Homo sapiens
ccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaaatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaacc

SEQ ID NO: 443349 - DNA, 2667 bp, Homo sapiens
gcggccgcaggtctagaattcaaccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaataggccatgaaggccgaattc

SEQ ID NO: 443350 - DNA, 2336 bp, Homo sapiens
ttatctgcgacacgctctaatcctcacggctaaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443351 - DNA, 3028 bp, Homo sapiens
  misc_feature (2438)..(2438): n is a, c, g, or t
  misc_feature (2442)..(2443): n is a, c, g, or t
  misc_feature (2454)..(2454): n is a, c, g, or t
  misc_feature (2457)..(2457): n is a, c, g, or t
  misc_feature (2479)..(2479): n is a, c, g, or t
  misc_feature (2481)..(2481): n is a, c, g, or t
  misc_feature (2489)..(2489): n is a, c, g, or t
  misc_feature (2492)..(2492): n is a, c, g, or t
  misc_feature (2500)..(2500): n is a, c, g, or t
  misc_feature (2509)..(2509): n is a, c, g, or t
  misc_feature (2515)..(2515): n is a, c, g, or t
  misc_feature (2517)..(2517): n is a, c, g, or t
  misc_feature (2522)..(2522): n is a, c, g, or t
  misc_feature (2533)..(2533): n is a, c, g, or t
  misc_feature (2544)..(2544): n is a, c, g, or t
gcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccccccccccacacccccncacnnccccccacccnacnaccgcaaagcccctccccgccnanccaggcanacngaataccnaaccccganatggcncnccccnccccacacaanacaaccccccnatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443352 - DNA, 1749 bp, Homo sapiens
tacaaagtaacggagttaagagtcaatgagctgtacatcagactagcagatagctttgtctctaagctgctgaaaatcggaacgaaaaggggcttcaaccaagttagtctgagagagagaggaatccagctcacatcagtgtgtagacaaagtctgaaagtgcatgctgatgagtttacgttttatgaggcaaacacttagaaaccattacagatttctaagccagagagttacaaatgcaaatttaggaaatgtcttatgcacatattcaatagaatattaagggaatttgatcatgtaaagaggcctgaatatgtacattaccacctatttctcttggtgagcttacttaccaagatttttttcagttcagctttacctttgcagttattttccaattctgagtctctctcaagctccagatttgcactggtcttatgtgccactgaaaagtcctgctggtatcttgaatgtactagtcttcacatttgtgcttatattcttgcctctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443353 - DNA, 873 bp, Homo sapiens
tttttaattttaatgtttatccaccagcagaaaaaatttaatatgtaaatccaccagcagaaaaaaaattaccaaaactaacattttacagatttttagtatcaaagcacaatacatttttcatagaaacaaatatatcaccattataggtaccatgatatggcaatatttatatacaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443354 - DNA, 3028 bp, Homo sapiens
gcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443355 - DNA, 1977 bp, Homo sapiens
  misc_feature (152)..(152): n is a, c, g, or t
cctaaatctgctttctctaacagaagggtcagacaggtattatccccctcgagaagaggaaacaaatgaaatagaacgacagcagtcacaagtccatgacacccatgtccggacaagatcagatgatagtagcagaagtaaaggccaagagnagacacggttgtgtcgcgagtggagtggtgaagtggtgacagttttgggggggggggggggtggggggggggggggtggggggggggtgggggggggtggggggtgggtgtggtggggggggcagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443356 - DNA, 2196 bp, Homo sapiens
gcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaa

SEQ ID NO: 443357 - DNA, 740 bp, Homo sapiens
tgagtttgggtgggctgtggctgttttgctcatcattttatcccagcttctggcacattgtcagcacacttcaaatatttattggatgaagtaatatttgcaactgtatttcctgttttgcagttttatttctccttgttttcatttaagaattttttaaaaaaaatttatgtcttaaagatttccacagataagattacacagggaaattttttttcttcaaatctgtggaacaaaacaaacaggtattgtggaaggtggaaaaatcgaagagacactcagaaatcaaggtttctgtctggagcaattttgcagttatatgaaagcgcttatttaaaaatgttaacttaccatagtatttataagtatcttattttttcagattacatttttccttctttcaaaccaaaacataaggaaccacagttccaaagagcctttaccaccagtctcagcgtgttctctcctcctgtttgatttaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaaactctaatgttgccctgtgccggacctgtggaacaaattgtttggaactccttgtcatccagatgaccctcttagacacagatggttattcacgagaccagtatttccccc

SEQ ID NO: 443358 - DNA, 503 bp, Homo sapiens
  misc_feature (503)..(503): n is a, c, g, or t
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacagcaggtagtatcttccccagcagatgttgctgattattccggagctgggttcn

SEQ ID NO: 443359 - DNA, 1818 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcgggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443360 - DNA, 1617 bp, Homo sapiens
tgcggctgaattacctcatactctgaagttaccaggcttacctctgtttcccaacaagtttcttatttctttagtgttgctaattttaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443361 - DNA, 1747 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443362 - DNA, 1925 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443363 - DNA, 1727 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443364 - DNA, 2027 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggtatggtaaatgtagacacccaagagagaaggaaaaacgtttcacggtccaataacaccttccttctctttctcttaataaagcatatgtctcaggtaagaggcaaaattactagaatattcactctcactgaaaatgagtaaaaacctaacttagatgaaaatccttatcttgttcatttttattcctggccttttggttgagaagaatgggccagaccatgtgtgtgtgtgtatgtgtgtgcgtgtgtgtgtgtgtgcgcacttgggtttatttatatgagccggtaaaatttcgttcaccattaatttatgttaatttaccaacttcttaaatgagaacagtgagaattttctcattgttaataatacactggcagtgcatatatgcatcacgaagagaggattttcccattgataatagatttccaaatacatcttcctgctttaagattttaatatatggatttatatataaaaactagttaagtcattggaaaagcaaactgtcatccttctcttatttgagatctcaactttagaaagtctatgttctcaactacagaaaataatttttagaccagctaactttcagatttctgcagtgcttattttctcccagttgagggttggtttttttttgtttgtttgtttgtttgtttttcctgattaaaaagtaagaatacggccaggcgcgatagctcatgcctttaatcccagcattttgggaggccgaggagggcagatcacctgaggtcaggagttcgagaccagcctggctaacatggtgaaacccagtttctactaaaaataaaaaaaattagtcgggcgtggtggtgcgtgtctgtaagcccagctactcaggaggctgaggcaggagaatcgcttgaaccccggaggtggagatggcagtcagctgagatagcaccattgcactccagcctgggcaacagagtgagacttcgtctcaaatagaa

SEQ ID NO: 443365 - DNA, 1001 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagcgccgcaaacgatcttgaacatcatgcccggtggtatttagaatactggaacttgtgtagctttgaaaccttggaataggttagggcttgcccataaacctgtccttcagggattatgccggctctcgcgtaataacttccaggtggcttggcccactttcatggctagatctggtaggtacac

SEQ ID NO: 443366 - DNA, 724 bp, Homo sapiens
gttgatattcagtctgagatgaaccaattagtagttattttgaggagacagttattactttttgggataacacatctatttggtattgccattttacagtggtttatctgttagtaagagtaacaagggtacttgatctctaaacagaggaaatatcttcaattaaaaacagaatttaaccaaagagtggggtaggaattgaatggggactattaccctagactggcaaagcagaagcttgtgaccttttacgttgttacagacacaggtactcttccctctatgcctgtagtacttccagcttgtatgtggaacgactgtaatgatcatcactgctttgtgactctctcctgctttttcccagaattctagagctttctgatgctctgcggctgaattacctcatactctgaagttaccaggcttacctctgtttcccaacaagtttcttatttctttagtgttgctaattttaggtaggtatgaaggaaggctgccttaagaataaggcttatccctgcatgaaggagatatttatgttttgaaagggagagaaaagaatctaatacagtatttagtgagcacctactatgtgtcaggtcttttgctaaatattttgtatgtattatctcattttatctttgcaacagaagtgctatcaagaagccaatgcttggagaagctaaataatatccctaatgttatatagtggttcttattatct

SEQ ID NO: 443367 - DNA, 380 bp, Homo sapiens
atttgcccctattgaaaataatgtattgaaatcagtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacagggtaagaccttttctttagatttgttttagattttgagaatgaaaaatgaatatacattcaaataagtgacagcttcttagaagtatacccaatggagttgtaaacctaattcagtgttaattttatatatatgtaatcattcatccaacatccagatttgcagtaaaggagagttctcgttag

SEQ ID NO: 443368 - DNA, 1979 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443369 - DNA, 1939 bp, Homo sapiens
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgaggtgtaggagctgcacgatctgggaacctcacgtttatggtgggaggagttgaagatgaatttgctgctgcccaagagttgctggggtgcatgggctccaacgtggtgtactgtggagctgttgggactgggcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443370 - DNA, 1355 bp, Homo sapiens
gacaagacgtctgtcttcgtgcaagttcatataaacattacaatctcatttaagaatatttttttaggagggaggtgagacaagacggcagaacagaaaactccacagatcatcctcctacccctaccacaaggatactaagttaacaaacaactacacaggaaaaagcatcttcctaagagctaaaaatcaggcggcaaagatctgcaacaacatgctgttagctattagtatgattggaactgctgaagctatgaatcttggaatcaggttagggcttgacccaaaactactggctaaaatcctaaatatgagctcaggacggtgttggtcaagtgacacttataatcctgtacctggagtgatggatggcgttccctcggctaataactatcagggtggatttggaacaacactcatggctaaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443371 - DNA, 1747 bp, Homo sapiens
  misc_feature (452)..(452): n is a, c, g, or t
  misc_feature (454)..(455): n is a, c, g, or t
  misc_feature (468)..(468): n is a, c, g, or t
  misc_feature (470)..(470): n is a, c, g, or t
  misc_feature (478)..(478): n is a, c, g, or t
  misc_feature (484)..(485): n is a, c, g, or t
  misc_feature (487)..(487): n is a, c, g, or t
  misc_feature (499)..(499): n is a, c, g, or t
  misc_feature (506)..(506): n is a, c, g, or t
  misc_feature (510)..(512): n is a, c, g, or t
  misc_feature (515)..(515): n is a, c, g, or t
  misc_feature (518)..(518): n is a, c, g, or t
  misc_feature (528)..(528): n is a, c, g, or t
  misc_feature (532)..(532): n is a, c, g, or t
  misc_feature (537)..(537): n is a, c, g, or t
  misc_feature (541)..(541): n is a, c, g, or t
  misc_feature (546)..(546): n is a, c, g, or t
  misc_feature (553)..(553): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (571)..(571): n is a, c, g, or t
  misc_feature (578)..(578): n is a, c, g, or t
  misc_feature (595)..(595): n is a, c, g, or t
  misc_feature (597)..(597): n is a, c, g, or t
  misc_feature (607)..(607): n is a, c, g, or t
  misc_feature (619)..(619): n is a, c, g, or t
  misc_feature (625)..(625): n is a, c, g, or t
  misc_feature (629)..(629): n is a, c, g, or t
  misc_feature (632)..(632): n is a, c, g, or t
  misc_feature (635)..(635): n is a, c, g, or t
  misc_feature (638)..(638): n is a, c, g, or t
  misc_feature (644)..(644): n is a, c, g, or t
  misc_feature (646)..(646): n is a, c, g, or t
  misc_feature (650)..(650): n is a, c, g, or t
  misc_feature (652)..(652): n is a, c, g, or t
  misc_feature (658)..(658): n is a, c, g, or t
  misc_feature (663)..(663): n is a, c, g, or t
  misc_feature (670)..(670): n is a, c, g, or t
  misc_feature (682)..(682): n is a, c, g, or t
  misc_feature (690)..(690): n is a, c, g, or t
  misc_feature (695)..(695): n is a, c, g, or t
  misc_feature (698)..(698): n is a, c, g, or t
  misc_feature (702)..(702): n is a, c, g, or t
  misc_feature (704)..(704): n is a, c, g, or t
  misc_feature (712)..(713): n is a, c, g, or t
  misc_feature (720)..(720): n is a, c, g, or t
  misc_feature (729)..(729): n is a, c, g, or t
  misc_feature (735)..(735): n is a, c, g, or t
  misc_feature (738)..(739): n is a, c, g, or t
  misc_feature (741)..(741): n is a, c, g, or t
  misc_feature (744)..(744): n is a, c, g, or t
  misc_feature (746)..(746): n is a, c, g, or t
  misc_feature (750)..(750): n is a, c, g, or t
  misc_feature (755)..(755): n is a, c, g, or t
  misc_feature (758)..(758): n is a, c, g, or t
  misc_feature (762)..(762): n is a, c, g, or t
  misc_feature (767)..(768): n is a, c, g, or t
  misc_feature (772)..(772): n is a, c, g, or t
  misc_feature (809)..(809): n is a, c, g, or t
  misc_feature (817)..(817): n is a, c, g, or t
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacagngnnggagcggcacgancngggaaccncacggnnanggggggaggagnggaagangaannngcngcngcccaagagnggcnggggngcangggcnccaacgnggnggacngnggagcggnggggacngggcaggcggcaaagancngcaacaacangcgggtagcgangaggangagnggnacntcngaagcnangaancntggaangaggngagggcnggacccaaaacnactgggcnaaaanccnaaanangagctcannccggggnggggcaagngacatngannanccngnaccnggagngangganggcgnncccncggcgaagaacgaggaggggggagggggaacaacacngagggcgnaggatctgggattggcacaagactctgctaccagcacaaagagcccaatccttcttggcagtctggcccatcagatctacaggatgatgtgtgcaaagggctactcaaagaaagacttctcatccgtgttccagttcctacgagaggaggagaccttctgagtgtgccctttggccacggacactgttgggaaccaaactctgtcttggagcctccttttagctcactccacaagtaaatggatttaatcaaaggtcacctatctgcttttgattgtctaggtcacagtaatccctaggatttttcaccgcttattctttttgtctttttaacaaacatattatccgaattttttttctgcaagccactgatagtctctgctaactagcttaattgacctttttacaaagtttgatccccaagcatcctcaactaaatcattgaatacttcaatcaggatattatctgctttactttacaaataaaaccaaatcttttgtcaacaggatgaaacccatcttaaaggaaagaaaaggaattggtgtgaagagagaagttagagaagggaaatgcagtgaattactatctgtgtccatcaggaagtttgtcctgttaaccaaatggttactgcactaccagggttactggtttattttccagggagctgataaagcaggagaactgttgctgcatgttttctatttggactccgtcacaatatggtaggatatccctcaccaactcccgacactcagcagacttgtttttatatttttttctttcttgtacattcttactacgtattttttgacttaagaatgacatctttagacgcatttcagagccaatgatgatatttgctttagataattattatattattataaatatagccatattattttgaattcaaataaatttctatactgg

SEQ ID NO: 443372 - DNA, 2689 bp, Homo sapiens
  misc_feature (1428)..(1428): n is a, c, g, or t
  misc_feature (1546)..(1546): n is a, c, g, or t
  misc_feature (2292)..(2292): n is a, c, g, or t
  misc_feature (2478)..(2478): n is a, c, g, or t
aggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaanaaaaaaaaaaaggatgctcgaaggacatttattaggaagagaagcaagcagcaccaggatttaaggcaggaaaggataggctaactctactgttttgtacaaatgcagttgggttganaatcaggactgcccttatctataaagttgctaacttctgaggctttaagtgaaaagataaataccagctgcctgtcttttggttgtacagcaagaaggcctggacgatgagaaccctgtttctggattgtttccatcaatggctttgtctctggagtcaggcaatatcttgccagtaagggactgacttttaaagttattttgatattggacagtacccctggccacccagaataacatgagttcaacactgaaggtgtccaaggggccaacttgcccctaaacataacgcccctaattcagcctctagagtaggggatcataaggacctttaaggctcattacacatggtactctatgggaaggattgtcactgtggaagaaaaccctgatagaacatgaaaatctggaaagattacaccattgaagatgccattgttattgtggaaaacgccttgaaggccatcaagcccctaacagtaaattcctgctggaaaaaactgtccagatgttgtgcaagacttcacaggatttatggcagggccaatcaaggaaatcactaaagagattgtgcatatggcaaaaaaggtggggagtgtatgaaggctttcaagatatggatcttggattaattcaagagctaatagacaccacagcagagtaattaacagaagaggcttgatggagatgagtgcttctgaacagtaccagatgatgaggaagaagatgtaccaaaagcagtgccangaaacaaattgacattagacagtatggcagaacggttctgattattcaagactcctttcaacttcttttacaacatggacccttctctgatacagacactgaaaataaagcaaacagtggaagacggattggtaccatacaaaaacgtttttagagaaatgaaagagcaaaaacatcagatagaanttacaatttccataaagttatccggagtgtgcctgccccttctgcctccccttctaccacctccacctcttctgcctctgtcaccccgagacagcgaagagcaacccctcctcttcctcctcagcctactcattattaagatgatgggattgaagacctttatgatgatccacttccacttaatgaataataaatatattttatcttcctt

SEQ ID NO: 443373 - DNA, 1005 bp, Homo sapiens
ccatatacggtctatgagccgtgttatcggagagggcgggcgcggcgaggttcagctccgggaagtaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctcccccggtggggatttgcccctggggcgccactgccttggtggcccccccctaatccttggggcccctttgcggcacgtccagcactcggggcttgggtcaatgggccatcgccccttgggtgttgttcgcgcccagatccattccatttggttgcgcgcgtgtggaggtcttccatctctttcgcgggggggctcttcacacgcgtacgtcacagttgtgtaagcacgggttccccatagtgtgcctgccacgaaagatactgggtgtagcgctacacacccgtccgagattttgtcgggg

SEQ ID NO: 443374 - DNA, 509 bp, Homo sapiens
ttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgcagctacctggaactggtcacctctaaccaccactcggtacaggccctgtcgtggcggaagctctacctgagcagggccaagctgaaggcctccagcaggacctccgccctcctctccggctttgccatggtgccatggtggaggtgcagctggagacgcagacgcgctaatggtacgagctga

SEQ ID NO: 443375 - DNA, 5359 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaagcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443376 - DNA, 4972 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443377 - DNA, 5531 bp, Homo sapiens
ggcgccccggccgggccactgggccacaggccacgcggccacgcagtccgagcgggagccgagccgggcggggcgagggcagctccgggaagtaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443378 - DNA, 5004 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaggcaggagaatggcgtgaacccgggaggcggaggttgcagtgagccgagatcacgccactgcactccagcctgggtaacagagcaagactctgtctcaaaaaaaacaaatcctaccactccacaaaaaacatgtgcggtccgctt

SEQ ID NO: 443379 - DNA, 4268 bp, Homo sapiens
ggcgccccggccgggccactgggccacaggccacgcggccacgcagtccgagcgggagccgagccgggcggggcgagggcagctccgggaagtaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagccctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443380 - DNA, 5422 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443381 - DNA, 5364 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaataatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443382 - DNA, 4918 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggagttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggattgcttgagcctgggaagtagaggctgcagtgaactataactgtgctagtggccgggcgcagtggctcacgcctgtaatcccagcactttgggaggccaaagcaggtggatcacttgaggtcaggagttcgagaccagcctggccaacatggtgaaactctgtgtctactaaaaatacaagaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcccggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctaaa

SEQ ID NO: 443383 - DNA, 2825 bp, Homo sapiens
ggcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctccccgaccccccgcagccactggcctccagctctcggccacagaatggcctctaaggctgactcagccgctcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactcaatctcaaaaaaaaaaaaaaaattagccgggcgtgatggcgggcacctgtagtcccagctactcaggaggctgaggcagaagaaatcctgaaaccccgggaatgccaaggttgtcatgtgaacgttgagactaacaggccatgtggacatacagagcgcggggaaccagcgggcgcaaccttggctccaaacaagaacacacgagagtccgggggagtcaccagcgcgccggaacaccaatttctcgcccaacacgcaagacactaccggcagaaccagctgaagccgaacagcgaaaatcg

SEQ ID NO: 443384 - DNA, 535 bp, Homo sapiens
atggttccacatggaggtgggaaaaggctccctctatctcaggcttccccttccctccagaaacactggctcctatggacacatgtgcctctgttccccttaacctgtgtaattcacacaccaccttcttttaggagaaaatcagggattctagtgttctcatctctacattttgttctttgctgttcatcatttccagtatggccctttggtattgctttcttttacatcgataatttgctggaagctactatgaatgttaagtgccctctacctttggattagctagacccttcgggagtgtgaaagggctccttcctgctcttagctcatgctggcgctctctgctttgcaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443385 - DNA, 627 bp, Homo sapiens
gggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaaggtgacaagtcttccttcaataaccaagaagagttccagcttaatgtctgctgaatctagaa

SEQ ID NO: 443386 - DNA, 633 bp, Homo sapiens
gatctgcctgtcttggcctcccacagtgctaggattacaggcgtaagccaccatgcccggcctgaaagtcaagttttgtgtcaatattttcacaggcctgtaaacattgtgagaagtccctgcatggaagaattagtgagaataacttaaaaacacacaaacacaccatcgtttggctttgttggtgtctctgcccatagttgagtattctaaatttcctgtgttataacagtgagtgagtttcaccagggcttcctaatttataagccctgtatctggatttttaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagag

SEQ ID NO: 443387 - DNA, 2294 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443388 - DNA, 2527 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaaggtctgggaagcagttcagattgcatccatgttggcttcctatgggggctgtggcatccagtgcagcagtggcaggagcttggtcctccttggatagggctgtctgtcgctctgccgtgatggcgagagctttcagactagttgaaatccggtgcccttagctgagagcaggagcattatggagaaggtacccctgagaggaggacagagttcagcacaaatgtctctcctcagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443389 - DNA, 3182 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaactcatgatcctcccacctcggcctcccaaagtgctgggattacaggtgtgagctaccgcgcccggccaacaacatgtttgatagatgtatacattgtgaaattaagctagtgacatctgtcacctcacacagtgaccctttggtgtgcgtgtggtgagaacattcaaaagctactttctagctgggtgtggtagcgcatgcctgtaatctcagctactgaagaggctgaggcatgagaattgcttgaacctgggaggcagaggttgcagtgagtcgagatctcaccagtgcactcccgtctgggtgacagagcaagactccacctcaactactttctgagcgatttttttttgtttttttggagaatatggtgtgtgctctctcacccaagttgggagtgcaggtggcgtgatctcggccgatgtgcagcctcgtgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443390 - DNA, 2607 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443391 - DNA, 2457 bp, Homo sapiens
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgagttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443392 - DNA, 2087 bp, Homo sapiens
ggtctcgaattcctgacctcgtgatctgcctgccttggcctcccaaagtgctgggattataggcaagagccaccatgcccggccacagaaaatttttttagagtagattcacttttggagatgatcataatagatgttaaattttttttttctgtttggtttcagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443393 - DNA, 2273 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttgggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443394 - DNA, 2172 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccaggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443395 - DNA, 2341 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaactcatgatcctcccacctcggcctcccaaagtgctgggattacaggtgtgagctaccgcgcccggccaacaacatgtttgatagatgtatacattgtgaaattaagctagtgacatctgtcacctcacacagtgaccctttggtgtgcgtgtggtgagaacattcaaaagctactttctagctgggtgtggtagcgcatgcctgtaatctcagctactgaagaggctgaggcatgagaattgcttgaacctgggaggcagaggttgcagtgagtcgagatctcaccagtgcactcccgtctgggtgacagagcaagactccacctcaactactttctgagcgatttttttttgtttttttggagaatatggtgtgtgctctctcacccaagttgggagtgcaggtggcgtgatctcggccgatgtgcagcctcgtgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagggcccggcccagagatcagagcagcagtctcaggcccacctcaaccacccagtccctgggaagccaacactagcggcacccacctgtctgacacgagcgtggcaaagggggcat

SEQ ID NO: 443396 - DNA, 2173 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttgattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaaggtgagctggccctgctcccagcctactgtctgtgggacgcaggagtcaggggatcctgaggtcacactttatgcctaccccagccatcctcctcctcacgagccacactggagacgtggggctgtggacgccaagagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443397 - DNA, 1766 bp, Homo sapiens
ttttgtagagatggggtttcaccgtgttagcgaagatggtcttgatttcctgacctcatgatcctcccacctcggcctcccaaagtgctgggattacaggtgtgagctaccgcgcccggccaacaacatgtttgatagatgtatacattgtgaaattaagctagtgacatctgtcacctcacacagtgaccctttggtgtgcgtgtggtgagaacattcaaaagctactttctagctgggtgtggtagcgcatgcctgtaatctcagctactgaagaggctgaggcatgagaattgcttgaacctgggaggcagaggttgcagtgagtcgagatctcaccagtgcactcccgtctgggtgacagagcaagactccacctcaactactttctgagcgatttttttttgtttttttggagaatatggtgtgtgctctctcacccaagttgggagtgcaggtggcgtgatctcggccgatgtgcagcctcgtgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443398 - DNA, 2275 bp, Homo sapiens
gggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaactcatgatcctcccacctcggcctcccaaagtgctgggattacaggtgtgagctaccgcgcccggccaacaacatgtttgatagatgtatacattgtgaaattaagctagtgacatctgtcacctcacacagtgaccctttggtgtgcgtgtggtgagaacattcaaaagctactttctagctgggtgtggtagcgcatgcctgtaatctcagctactgaagaggctgaggcatgagaattgcttgaacctgggaggcagaggttgcagtgagtcgagatctcaccagtgcactcccgtctgggtgacagagcaagactccacctcaactactttctgagcgatttttttttgtttttttggagaatatggtgtgtgctctctcacccaagttgggagtgcaggtggcgtgatctcggccgatgtgcagcctcgtgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443399 - DNA, 929 bp, Homo sapiens
  misc_feature (10)..(11): n is a, c, g, or t
ctagtggatnncccgggctgcaggaattcgattaccattctggaagcaacacactcatagagccagtcttgccgtgatgggcacttacactcttagcagatcccagacactgttaatcagccgagtttccagctctgccgatccagctgcatttagagcccaaagagtggctctgcggtggagtgaggctgtgaggccactccggtccccacagggctcaggaatggagtgatttgtggagtgaaagccgtttaccttttcttttcccctgcaaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443400 - DNA, 428 bp, Homo sapiens
gtcagggctggggttggcgctgtttccctgtccaggtgggttgctattgctagctcagcctggctcaatggggaagcagtgctggaggtggctccagaaaagcagagagagtggaatgaggatgaccaagtctgccccttcatttctcccctcactgttgagtaatgtaaacatgagttattaccctgcagagaggcagttgcatgttcacgaccatttctgaaagcatatggtattcacgatccacaggaagatgtgatttgaggcatctggagaggtaatagaagagctgacacgtagggagaaacacgtagggagaaaaaaaatagaagagctgacatgtagggagcaacgttttgctccccttgaagccacacacactcatagagccagtcttgccgtgatgggcacttacactcttagcagat

SEQ ID NO: 443401 - DNA, 592 bp, Homo sapiens
gcctggcacagaagtaatatttggtgaaagtgcatttgctttttcctagcacagtctgtcattcaggaccatgtgtgtgactgcttaaaagggataaacctatgtagtcagcttgtctgccttaaagttctctgttccttggataaaggaacttgctgcagatgaagctgaggcttttgtgtgtgatgagagtctctcctcccagctggccctctcctcctccatctccttgactgggtccggctccatgtgtgcgaggtggacagtttgtcggcagatgttctgggcagtgagaatccaagcaaacatgacagcttctggaacttgggtaagacaggccgggcccccacctcccaccatgtgtcctactgtccctggtgctgccgggtgggtctgaggacacccactgagcctccagcagtaggctggcttttggagtctgttactatggagactcttttggatcttttcttccctgctctatgggagagtctaaaaccgaggtaccatgtaagaaaaataatgctttgaagacttttccagggtaaaaggaaatttgatttctttgtggatctaaggaagagaagacaca

SEQ ID NO: 443402 - DNA, 428 bp, Homo sapiens
  misc_feature (10)..(11): n is a, c, g, or t
ctagtggatnncccgggctgcaggaattcgattaccattctggaagcaacacactcatagagccagtcttgccgtgatgggcacttacactcttagcagatcccagacactgttaatcagccgagtttccagctctgccgatccagctgcatttagagcccaaagagtggctctgcggtggagtgaggctgtgaggccactccggtccccacagggctcaggaatggagtgatttgtggagtgaaagccgtttaccttttcttttcccctgcaaagttcgcagcatttgtaagatcttagccatgaaagccgtccgcaacaatcgcctgggttctgccctctcttggagcatccgtgctaaggatgccgcctttgccacgctcgtgtcagacaggtgggtgccgctagtgttgcttcccagggactgg

SEQ ID NO: 443403 - DNA, 2301 bp, Homo sapiens
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443404 - DNA, 2425 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcttcctctgaagacgggccagttccttgctgtctggcaagaggaaacagctggggtgcacttcactgggagttgggcaagatgtcggcagtttcctggtgcccttcaagtcctccaaaagtatcgagctaacatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443405 - DNA, 2192 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443406 - DNA, 2207 bp, Homo sapiens
gaaaaaaaaaaagaaaaaaaacaaaaaacaaaaaatacatcacaataagaggccgaatgtaaataaagacgagggacgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443407 - DNA, 2159 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttgcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443408 - DNA, 1565 bp, Homo sapiens
agtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggctgcctgggggtccggctgtctggtactagctttttcataccggcgcctcgcgggggcccttttacgcg

SEQ ID NO: 443409 - DNA, 1952 bp, Homo sapiens
ggtctcgaattcctgacctcgtgatctgcctgccttggcctcccaaagtgctgggattataggcaagagccaccatgcccggccacagaaaatttttttagagtagattcacttttggagatgatcataatagatgttaaattttttttttctgtttggtttcagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttgcctgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443410 - DNA, 2349 bp, Homo sapiens
gatctgcctgtcttggcctcccacagtgctaggattacaggcgtaagccaccatgcccggcctgaaagtcaagttttgtgtcaatattttcacaggcctgtaaacattgtgagaagtccctgcatggaagaattagtgagaataacttaaaaacacacaaacacaccatcgtttggctttgttggtgtctctgcccatagttgagtattctaaatttcctgtgttataacagtgagtgagtttcaccagggcttcctaatttataagccctgtatctggatttttaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctcttcctctgaagacgggccagttccttgctgtctggcaagaggaaacagctggggtgcacttcactgggagttgggcaagatgtcggcagtttcctggtgcccttcaagtcctccaaaagtatcgagctaactcatgatcctcccacctcggcctcccaaagtgctgggattacaggtgtgagctaccgcgcccggccaacaacatgtttgatagatgtatacattgtgaaattaagctagtgacatctgtcacctcacacagtgaccctttggtgtgcgtgtggtgagaacattcaaaagctactttctagctgggtgtggtagcgcatgcctgtaatctcagctactgaagaggctgaggcatgagaattgcttgaacctgggaggcagaggttgcagtgagtcgagatctcaccagtgcactcccgtctgggtgacagagcaagactccacctcaactactttctgagcgatttttttttgtttttttggagaatatggtgtgtgctctctcacccaagttgggagtgcaggtggcgtgatctcggccgatgtgcagcctcgtgcttcccaggctcaagcaatactcccaccccagcttctcgagtagctgggattacaggtgtgtgccaccatgcctggctaatttttgtatttgtagagatggggttttgccatgttgcccaggctggtcttaaattcctggactcaggtgatctgcctgccttggcctcccaaagtactgggatcacgggcatgagctatcatcacgcccggccccatctctttgagggacaggacatgtggggtttcttgctcacccccactcttgtgggacgcggcctgtgccctgattttccttcttgccttggtgtctgaatctgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443411 - DNA, 1518 bp, Homo sapiens
gggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaacatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443412 - DNA, 880 bp, Homo sapiens
aaatctcctgctttgtggagtggctggtctgaggtttttcttctcctgtttagggccagggtgacttttgtaggtgtcacttgggcaatttgggggaatatgcaggttactcagtgctcttgtttcgccataggaaagtatcgcgagttccaccgtatgtacggggagaagcgttttgccgacgcagcttctctccttctgtccttgatgacgtctcggattgcccctcggtctttctggatgactctgctgacagatgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagattttttaaaagaataaatgttgttttgcaaatgta

SEQ ID NO: 443413 - DNA, 979 bp, Homo sapiens
cgaccagaagaaagtaggagagaacctagtaaacttgagattggaggttatgtgaaatcaccaaactagatgattccagcaaaaagagtttctgtgatgtgtgtgtaggttcacaccccttaagataaccatacttgactgtatgatagtcgcaggagtcacttacttactacagatgcatcagagaccatgtgatgaagaagatggcttcccagtggagttgcaaggtgcctctggggggtgtgtttttaaattgtcaacagcttccacatggtgtttatatccttaacttttggcattgggggcattcagatgaggtcatccgcttgggtccatttcctgagtgttgatcattttgcgacacagagaacagcgtcttctattcttagagccttcaagcctaaatgctccctgcctggctccaggcccatgcccccttcctccccacccactttccccagaaaatttttgttgtggaaaattacacattcacaaattgtgtttctttcctcacaccaagcatattcccacacagagacagattctggaatgatctcatggatgactcatgccattatctggctgtttataggagctgcctttagacaaagatttggtcataagctacgttaagaccccttcattgtctgccagttgcccttgcaggggatggcttatggcttatcgatggagtcctgagtgggagtgggaagggacttctagactaaaagctgcttttgacttcacttttgtccatcaactgtggaccctgttccattgtctctgaactctggaggcaccttctgcttgatgtcagcaagcaggcctggtccaagatggcagctgcactgtatcggaagggcaacaaacgggactcttaagctaaggggaagacttgtgtcgtcgacttccggcccatgtgtaatctcttaattaaaatttagctcacaagtggtatttcctttcgtaatccagcttt

SEQ ID NO: 443414 - DNA, 451 bp, Homo sapiens
cccactgattctacattatggtggtttgtataattatttcattatatattacaatgtaataataataatagaaataaagtgcacaataaatgtaatgtagttgaattattccgaaaccatacccccaccttggttcatggaaaaaccgaggtgcttttggcaccagtgactggtttcttccacaaaaccagtccctgatgtcaaaaaggttggggagtgctgctttagggcactgcccagacaccacttcagagctgctgaactcattccctcagctgttggctctcagctgcatcctgcttcaagaactgctgcagggagccacctcgcctaacattgcttcctcttcccagggctgcccatcaacccacctccaatgactggtcggtccagtccccttgctttaagggaaatcaatgctaaagagctacgacacttccagaactcctcg

SEQ ID NO: 443415 - DNA, 1964 bp, Homo sapiens
  misc_feature (440)..(440): n is a, c, g, or t
  misc_feature (443)..(445): n is a, c, g, or t
  misc_feature (453)..(453): n is a, c, g, or t
  misc_feature (585)..(585): n is a, c, g, or t
agacatacagaaaagtgcacataagtggacagctccatggatttcacaaagggagcacagtcacataatcagcatccaggtcgggaaacagcataaccagcaaagccccctgagcctcctaccagttaccacccagtcccctcccaaggtagccaacatcctcgcatccagatggctttcactctccctggttacaaactgcttttcttaacaagcttttttttttttttttttttgagacagagtcttgctctgtcatccaggctagagtgcagtggcccaatcggctcactgcaacctccgcctccggggttcaagtgattctcctgtcttaggcttccagtacctcccgcctgtaatcccagcactttgggaggccgaggcgggtggatcacttgaggtcagagaccagtctggccaacatggtgaaaccctctctnctnnnagtacaanaattagccgggcatggtggcacgtgcctgtaatcccagctactcggggctgaggcaggagagtcgcttgaacccaggaggtggaggttgcagtgagctgagatcgcgccactgcactgcagcctgggcgacngagggagaccctgtctcaaaaaaaaaaaaagaatgaggtttttttctttgtgatctaccatatggaaaggtttgtatatattttatggcattgtttgggaaaaatgcaaactgtgtgcttcctatgctctcacatcaccacaatcatgaccacagaagagttctgtgaccaaatgtgttgggtttcttccccacacaccaagcagcagacacccgctgggtgtcctctgatttaattccaacactatttacccagagatagcatcagattccatgagttgagggctgagtccccaagcctgcctcccttcaggcactagttcagtcccaaatctgcctccccactttcaggcactagctgcaggtcagggcctcaggcctccagaatttctgaccaactggctccaggtaggggtttccataactccctctttgggctcagtttgctggagtggctcacagagctcaggataacacatttaccagtttattacaaaggatgttacaaagggtacagatgagcaggtgcatagggcgaggtgtaggagaaggagcatggagtttccatgccctccccgggcgtgccaccctccaggagcctccagagctgagatcgcgccactgcactccagcctgggtgacagagtgagactctttctcaaacaaaacaaaaccaaaatatctcctgttacagatacacatttctgtcttatcctcttcgcctttctttatgaacattgttggtatgttcaatggaattagggaaattagttgggaaatgttggcagttgttggacaagagatgatagtggcttacaaagaaaatgttgcaggtagaccttccatgacttggtaatggattgattactaggtatattaatccaggttcatactgctgtaaagaactgcccgagactaggtaacttataaaggaaagaggtttaattgactcacagttcacagcatggctggggaggcctcaggaaacttacaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 443416 - DNA, 639 bp, Homo sapiens
agacatacagaaaagtgcacataagtggacagctccatggatttcacaaagggagcacagtcacataatcagcatccaggtcgggaaacagcataaccagcaaagccccctgagcctcctaccagttaccacccagtcccctcccaaggtagccaacatcctcgcatccagatggctttcactctccctggttacaaactgcttttcttaacaagcttttttttttttttttttttgagacagagtcttgctctgtcatccaggctagagtgcagtggcccaatcggctcactgcaacctccgcctccggggttcaagtgattctcctgtcttaggcttccagtacctgggattataagtgtgcatcaccatgcctgtagacagagcaagaccctatctcaagcaaagaaactcaaaataattatgatttccccaacaaaatgcaggcaatggtccctatggccccaaaagtaatatagatgtttcacatcatgtgattttattccttagtaaccttcctttctatgaaatcatctctaagagggctaaatgatcctttcttgtggactgtgttgttaaaatgaaaagtccattttgctgatacgtaatctacctttccatgtaattttttaaaaaatc

SEQ ID NO: 443417 - DNA, 1131 bp, Homo sapiens
  misc_feature (249)..(249): n is a, c, g, or t
  misc_feature (252)..(254): n is a, c, g, or t
  misc_feature (262)..(262): n is a, c, g, or t
agcttaattgaagtgagtagagaagcatagtgattgatagcaagtacttttacatctgacccaaggtttagacccatgctgcaatttcagttttgatttccttttctgacctcataattggttaacaatgaggttttttcgactgggcacggtggctcccgcctgtaatcccagcactttgggaggccgaggcgggtggatcacttgaggtcagagaccagtctggccaacatggtgaaaccctctctnctnnnagtacaanaattagccgggcatggtggcacgtgcctgtaatcccagctactcggggctgaggcaggagagtcgcttgaacccaggaggtggaggttgcagtgagctgagatcgcgccactgcactccagcctgggtgacagagtgagactctttctcaaacaaaacaaaaccaaaatatctcctgttacagatacacatttctgtcttatcctcttcgcctttctttatgaacattgttggtatgttcaatggaattagggaaattagttgggaaatgttggcagttgttggacaagagatgatagtggcttacaaagaaaatgttgcaggtagaccttccatgacttggtaatggattgattactaggtatattaatccaggttcatactgctgtaaagaactgcccgagactaggtaacttataaaggaaagaggtttaattgactcacagttcacagcatggctggggaggcctcaggaaacttacaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 443418 - DNA, 817 bp, Homo sapiens
agacatacagaaaagtgcacataagtggacagctccatggatttcacaaagggagcacagtcacataatcagcatccaggtcgggaaacagcataaccagcaaagccccctgagcctcctaccagttaccacccagtcccctcccaaggtagccaacatcctcgcatccagatggctttcactctccctggttacaaactgcttttcttaacaagcttttttttttttttttttttgagacagagtcttgctctgtcatccaggctagagtgcagtggcccaatcggctcactgcaacctccgcctccggggttcaagtgattctcctgtcttaggcttccagtacgtgtgatggcgcttgtgtgtagtcccagctacttcagaagctaaggtaggaggatcacttgagccccagagttcaaggctgcagtaagctgtgtttgcaccactgcatgccatcttggctcactgtaacctccgcctccccagttaaggtgattctcctgccttagcctcctgagtagctgggattataagtgtgcatcaccatgcctgtagacagagcaagaccctatctcaagcaaagaaactcaaaataattatgatttccccaacaaaatgcaggcaatggtccctatggccccaaaagtaatatagatgtttcacatcatgtgattttattccttagtaaccttcctttctatgaaatcatctctaagagggctaaatgatcctttcttgtggactgtgttgttaaaatgaaaagtccattttgctgatacgtaatctacctttccatgtaattttttaaaaaatc

SEQ ID NO: 443419 - DNA, 2524 bp, Homo sapiens
  misc_feature (1000)..(1000): n is a, c, g, or t
  misc_feature (1003)..(1005): n is a, c, g, or t
  misc_feature (1013)..(1013): n is a, c, g, or t
  misc_feature (1145)..(1145): n is a, c, g, or t
gcctgcctcggcctcccaaagtgctgggattacaggcatgagctaccgtggctggcctatttatttgattatatcatctgcaaatagtgatacttctccctcctttccaatttgtgtatctccataatacatctcgtgactctagctgagttggctaatgccccagaacaatgtagataacattggcaatcaaggttgtccttgccatgttttgactttaattggagtgcttctagcactgcctcggtaaacatgatactgagttttggaggtcagggaaatatttagctgctcatatgttattgagagttttttaaaaatcaagaatagatgttgaaatatctattaacatggcaaattattatgagatcctctaattttgagtcatcctggcattcatgaaacagcttatttgtgcatctccatttgtttatttaattcatccttgcatctccattcataagagatatgaatgtgtatatgtgaggtatttctgttatgttttcataacagtgttatgtttgttccatcaagtttgtgtgagagctgttctcgtttctctgctggggcagtgtttacacagagaattggaaggcgctgtccttcaagccgccgcaacacccctggacatctgggccagatgcctttgtgtggaggggaaaggggagtaggacctttctttcacaacattctctagtttttctgtttctgttttcttgttttttgcaatccattttggtaaatcctatttttgtagcaaatatccatttcatccatagaattcaccaagcccttaccaatttagtgttttcttggtattttacccatgctgcaatttcagttttgatttccttttctgacctcataattggttaacaatgaggttttttcgactgggcacggtggctcccgcctgtaatcccagcactttgggaggccgaggcgggtggatcacttgaggtcagagaccagtctggccaacatggtgaaaccctctctnctnnnagtacaanaattagccgggcatggtggcacgtgcctgtaatcccagctactcggggctgaggcaggagagtcgcttgaacccaggaggtggaggttgcagtgagctgagatcgcgccactgcactgcagcctgggcgacngagggagaccctgtctcaaaaaaaaaaaaagaatgaggtttttttctttgtgatctaccatatggaaaggtttgtatatattttatggcattgtttgggaaaaatgcaaactgtgtgcttcctatgctctcacatcaccacaatcatgaccacagaagagttctgtgaccaaatgtgttgggtttcttccccacacaccaagcagcagacacccgctgggtgtcctctgatttaattccaacactatttacccagagatagcatcagattccatgagttgagggctgagtccccaagcctgcctcccttcaggcactagttcagtcccaaatctgcctccccactttcaggcactagctgcaggtcagggcctcaggcctccagaatttctgaccaactggctccaggtaggggtttccataactccctctttgggctcagtttgctggagtggctcacagagctcaggataacacatttaccagtttattacaaaggatgttacaaagggtacagatgagcaggtgcatagggcgaggtgtaggagaaggagcatggagtttccatgccctccccgggcgtgccaccctccaggagcctccagagctgagatcgcgccactgcactccagcctgggtgacagagtgagactctttctcaaacaaaacaaaaccaaaatatctcctgttacagatacacatttctgtcttatcctcttcgcctttctttatgaacattgttggtatgttcaatggaattagggaaattagttgggaaatgttggcagttgttggacaagagatgatagtggcttacaaagaaaatgttgcaggtagaccttccatgacttggtaatggattgattactaggtatattaatccaggttcatactgctgtaaagaactgcccgagactaggtaacttataaaggaaagaggtttaattgactcacagttcacagcatggctggggaggcctcaggaaacttacaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 443420 - DNA, 1882 bp, Homo sapiens
  misc_feature (1000)..(1000): n is a, c, g, or t
  misc_feature (1003)..(1005): n is a, c, g, or t
  misc_feature (1013)..(1013): n is a, c, g, or t
gcctgcctcggcctcccaaagtgctgggattacaggcatgagctaccgtggctggcctatttatttgattatatcatctgcaaatagtgatacttctccctcctttccaatttgtgtatctccataatacatctcgtgactctagctgagttggctaatgccccagaacaatgtagataacattggcaatcaaggttgtccttgccatgttttgactttaattggagtgcttctagcactgcctcggtaaacatgatactgagttttggaggtcagggaaatatttagctgctcatatgttattgagagttttttaaaaatcaagaatagatgttgaaatatctattaacatggcaaattattatgagatcctctaattttgagtcatcctggcattcatgaaacagcttatttgtgcatctccatttgtttatttaattcatccttgcatctccattcataagagatatgaatgtgtatatgtgaggtatttctgttatgttttcataacagtgttatgtttgttccatcaagtttgtgtgagagctgttctcgtttctctgctggggcagtgtttacacagagaattggaaggcgctgtccttcaagccgccgcaacacccctggacatctgggccagatgcctttgtgtggaggggaaaggggagtaggacctttctttcacaacattctctagtttttctgtttctgttttcttgttttttgcaatccattttggtaaatcctatttttgtagcaaatatccatttcatccatagaattcaccaagcccttaccaatttagtgttttcttggtattttacccatgctgcaatttcagttttgatttccttttctgacctcataattggttaacaatgaggttttttcgactgggcacggtggctcccgcctgtaatcccagcactttgggaggccgaggcgggtggatcacttgaggtcagagaccagtctggccaacatggtgaaaccctctctnctnnnagtacaanaattagccgggcatggtggcacgtgcctgtaatcccagctactcggggctgaggcaggagagtcgcttgaacccaggaggtggaggttgcagtgagctgagatcgcgccactgcactccagcctgggtgacagagtgagactctttctcaaacaaaacaaaaccaaaatatctcctgttacagatacacatttctgtcttatcctcttcgcctttctttatgaacattgttggtatgttcaatggaattagggaaattagttgggaaatgttggcagttgttggacaagagatgatagtggcttacaaagaaaatgttgcaggtagaccttccatgacttggtaatggattgattactaggtatattaatccaggttcatactgctgtaaagaactgcccgagactaggtaacttataaaggaaagaggtttaattgactcacagttcacagcatggctggggaggcctcaggaaacttacaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 443421 - DNA, 2523 bp, Homo sapiens
  misc_feature (999)..(999): n is a, c, g, or t
  misc_feature (1002)..(1004): n is a, c, g, or t
  misc_feature (1012)..(1012): n is a, c, g, or t
  misc_feature (1144)..(1144): n is a, c, g, or t
gcctgcctcggcctcccaaagtgctgggattacaggcatgagctaccgtggctggcctatttatttgattatatcatctgcaaatagtgatacttctccctcctttccaatttgtgtatctccataatacatctcgtgactctagctgagttggctaatgccccagaacaatgtagataacattggcaatcaaggttgtccttgccatgttttgactttaattggagtgcttctagcactgcctcggtaaacatgatactgagttttggaggtcagggaaatatttagctgctcatatgttattgagagttttttaaaaatcaagaatagatgttgaaatatctattaacatggcaaattattatgagatcctctaattttgagtcatcctggcattcatgaaacaaaaacccttttgtgtttatcaattattattttaatatgctgctggattttgtttgcttatttgtgcatctccatttgtttatttaattcatccttgcatctccattcataagagatatgaatgtgtatatgtgaggtatttctgttatgttttcataacagtgttatgtttgttccatcaagtttgtgtgagagctgttctcgtttctctgctggggcagtgtttacacagagaattggaaggcgctgtccttcaagccgccgcaacacccctggacatctgggccagatgcctttgtgtggaggggtcttgttttttgcaatccattttggtaaatcctatttttgtagcaaatatccatttcatccatagaattcaccaagcccttaccaatttagtgttttcttggtattttacccatgctgcaatttcagttttgatttccttttctgacctcataattggttaacaatgaggttttttcgactgggcacggtggctcccgcctgtaatcccagcactttgggaggccgaggcgggtggatcacttgaggtcagagaccagtctggccaacatggtgaaaccctctctnctnnnagtacaanaattagccgggcatggtggcacgtgcctgtaatcccagctactcggggctgaggcaggagagtcgcttgaacccaggaggtggaggttgcagtgagctgagatcgcgccactgcactgcagcctgggcgacngagggagaccctgtctcaaaaaaaaaaaaagaatgaggtttttttctttgtgatctaccatatggaaaggtttgtatatattttatggcattgtttgggaaaaatgcaaactgtgtgcttcctatgctctcacatcaccacaatcatgaccacagaagagttctgtgaccaaatgtgttgggtttcttccccacacaccaagcagcagacacccgctgggtgtcctctgatttaattccaacactatttacccagagatagcatcagattccatgagttgagggctgagtccccaagcctgcctcccttcaggcactagttcagtcccaaatctgcctccccactttcaggcactagctgcaggtcagggcctcaggcctccagaatttctgaccaactggctccaggtaggggtttccataactccctctttgggctcagtttgctggagtggctcacagagctcaggataacacatttaccagtttattacaaaggatgttacaaagggtacagatgagcaggtgcatagggcgaggtgtaggagaaggagcatggagtttccatgccctccccgggcgtgccaccctccaggagcctccagagctgagatcgcgccactgcactccagcctgggtgacagagtgagactctttctcaaacaaaacaaaaccaaaatatctcctgttacagatacacatttctgtcttatcctcttcgcctttctttatgaacattgttggtatgttcaatggaattagggaaattagttgggaaatgttggcagttgttggacaagagatgatagtggcttacaaagaaaatgttgcaggtagaccttccatgacttggtaatggattgattactaggtatattaatccaggttcatactgctgtaaagaactgcccgagactaggtaacttataaaggaaagaggtttaattgactcacagttcacagcatggctggggaggcctcaggaaacttacaatcatggcagaaggtgaaagagaagcaaggcatcttcttcacaaggcagcaggaaggagaagtgttaagcgaagcagggagagccccttataaaaccatcagacctcgtcgggtgcggtggctcatgcctgtaatcccagcactttgggaggccaaggtgggcggatcatgaggtcaggagatcaagaccatcctggctaacatggtgaaactccatctctactaaaaatacaaaaaattagctgggtgtggtggcaggcacctgtagtcccagctacttgggaggctgaggcaggagaatggtgtgaacctgggaattggagtttgcagtgagcagaggtcgtgccactgcactccagtctgggcgacagagcgagactcagtctc

SEQ ID NO: 443422 - DNA, 506 bp, Homo sapiens
  misc_feature (4)..(4): n is a, c, g, or t
  misc_feature (9)..(9): n is a, c, g, or t
catncgctngcccattttttaggccaaaagtcttctgggatgcatccagccaccctgcaccccactgccatgccccgcccgtgccactacctccctctccaccccacaactgctgcctccgcctcttacacggcatcccatccttgccttctgccacctccctgtgcggtcaggtgccctttgaaaggagtttgagcaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443423 - DNA, 1958 bp, Homo sapiens
tggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443424 - DNA, 1985 bp, Homo sapiens
gcgagcgcgagttgtgcacccggcggagcccggaggagcccggcgcacctcgcgcggcggccgctcccgctggagccggagcccgagcccgagcccgagcccgggtgaggggcggggagagacacgggctgcggcgcggcaggagagtggggggtcgggcgccccccgcagctcaggacatgggagtcccaccgtattgtccaggctggtctcgaactcctgacctcaagcagtcctcctgctttggcatcccaaagtgctgggattacagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443425 - DNA, 1925 bp, Homo sapiens
tggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443426 - DNA, 829 bp, Homo sapiens
  misc_feature (38)..(38): n is a, c, g, or t
  misc_feature (53)..(53): n is a, c, g, or t
acggagagagagacaaaacttaggctaggtacgaggcngggtgtgaatcggcngagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggacaaaacaaaaagacgagaaaaacacaacaaaaacacacaaaacaacacaaaacaaaacacgcagcgcttctactgtgtcggaaaaaagtaaaaaggagggcacatgttccccca

SEQ ID NO: 443427 - DNA, 883 bp, Homo sapiens
gggctggtagcaaatgcggatgccttcttggagccgcgccagcgccagaaatagccccggctcggagtcccaattagaggagcgcagcacgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccagcgccggcacccaggcaaagaccgcacacacatcaggatccggacgaacacgcccgaaccaagagacgcaaacagttacaaccgctgcaaagatcacatggaacacgcagcaacccagcgcgtagacgacaccaacgaactggccgagcaaaccaccgaggattccaaaaacacactgaccgctaacaggccgaaacgaacaaaagaccgacacgcacaaaaccatcggcactgaaccacacagtaaaacagcaaccgcaagccaacgcaaggctctaacggaccccc

SEQ ID NO: 443428 - DNA, 752 bp, Homo sapiens
  misc_feature (697)..(697): n is a, c, g, or t
  misc_feature (737)..(737): n is a, c, g, or t
tggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgccccccggncccttttccccaagggccccacccatttaaccaacccggncctttttgggcccgg

SEQ ID NO: 443429 - DNA, 1288 bp, Homo sapiens
ctggaaaaatgtgtagcctaggcctccggcgtctcatccatctgtagcctggggataaggactaggatgaagatgtggaggactgtcctttttaagcctgtaatacagggtattcccaaatacaggttgcaggccctccttccaatgagaagttttaggaaaactcaaaattgatggggttaattaaaccccaacaggcctctaagaagaaggaagatgctagaaaatgaccaagaaggttttaggatgagccctaaacctcatcctaaaggatgagggccagccagggtctgttaggcggtgcatttcagttggagaattccctacccatctgacaaagtcccatctgactccagttgggcagaggaggggtaaggggaaagaggagggtggcctttggctttgggctcactttcctcccccacctcacccactagcttcaaccatctcctccctccctcaattataccaatctgaattctccagggatttaccctgggtgagaacagagaagagagctggtggtgggcaccacccctggctgtgtgattggctctttttggtcctgagtcttgcaccttgccagataggcaatattgtcagtgagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccccaaccgggcccatgagacacatatcacaccaagggcccaaaaaaatagaaagcaaccggacatcttggagagccaaaacccggcaattttaagaaccaatgaatgaagaagtacaaaggaagcaaagaataaaaaagaaaagacaaagcgaatagaagggataaccacaatggagtaaaaaagaaaaaagacaatagaaacaaacatggaaaatagataaaaaaaaaccac

SEQ ID NO: 443430 - DNA, 2430 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgggaaaaaaaaaaaaaaaaacaaaaaaaaaagggggacacagcaaaaaaagtaccccacagagggggccaaaaagataacgcagataccgagatctaggacaccaaggcggcccacaataaagaacccacaaatcaaaccgcaacggacgaaggcacgacattatacaaaagcgctgagaaactgggcgacaacaccagcgccccaccagggcagatctctgggcgaacagccgcccgacctaaccccacgtgcagtgatgcgccccacaatgcgcacccacacacccccatcaacgagaagatgctaaaaacagaccgcaccaaaagcgagcaaacgacagaccgaccctgaccagccgtgcgaccaacacgggcgacacgaacacaactgcgacaaacactagactagcacgccgagcaagcacaccagagatgggcaaccaccggaagagagaatgacgcatcaccgcagaacggaaccttaacccgacagacgaggcaacgacgggagaa

SEQ ID NO: 443431 - DNA, 2166 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgggaaaaaaaaaaaaaaaaacaaaaaaaaaaaaaaaaacccgggggccttcatattgtcgggcgggggggaacaagaaggctaatctggaaacgggcacccggggccccaacacgccggtggttccgtggaaccccattttttttggtcaccagggggggacaaactcggcgggcccccccaaaaagagagggcggcaaaaattgcaaaaccccgggttaacccggttttagagctgcgcgaaaaacaca

SEQ ID NO: 443432 - DNA, 2043 bp, Homo sapiens
  misc_feature (4)..(4): n is a, c, g, or t
  misc_feature (38)..(38): n is a, c, g, or t
  misc_feature (1937)..(1937): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggcaaacacaacaataacacnaaaaaccccgggacatttgcgcgcgggacatgctttaggtgcacgtcaactagttcagaccattcgacaagggactgcggcccaagggcgttttcgacacgcacga

SEQ ID NO: 443433 - DNA, 2201 bp, Homo sapiens
  misc_feature (4)..(4): n is a, c, g, or t
  misc_feature (38)..(38): n is a, c, g, or t
  misc_feature (1934)..(1934): n is a, c, g, or t
  misc_feature (1940)..(1940): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaaaaaaaanaaaaanaaaaaaaaaaaaagaaaaaaaaaaaaaaaaacaaaaaaaaaaaaaaaaacccgggggccttcatattgtcgggcgggggggaacaagaaggctaatctggaaacgggcacccggggccccaacacgccggtggttccgtggaaccccattttttttggtcaccagggggggacaaactcggcgggcccccccaaaaagagagggcggcaaaaattgcaaaaccccgggttaacccggttttagagctgcgcgaaaaacaca

SEQ ID NO: 443434 - DNA, 2160 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443435 - DNA, 1843 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443436 - DNA, 1949 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtagggccacctcctccccctgttctgttggggaggggccacctcctccccctgttctgttggggaggggtagccatgatttgtcccagcctggggctccctctctggtttcctatttgcagttacttgaataaaaaaaatatccttttctgg

SEQ ID NO: 443437 - DNA, 1801 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctggtttcctatttgcagttacttgaataaaaaaaatatccttttctgg

SEQ ID NO: 443438 - DNA, 1616 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgccccccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443439 - DNA, 1696 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443440 - DNA, 1912 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgagacgctaccacaacacccacatactgatactacaatgaacaaccccaaggaatctgattaccaaaaaacatactgatacaacaaaaaaccacagaaaaaaaagagaaggaagaaacgtacaaaagtccataatacgaatcacgacactcagaagcagatacaagcaaccaatagacaacacaacaacagccaccagtaaagaccacagaacaacaacccccaagaatagtatcagaagggaaagagggcgatagcgaaggcaagaaaaactaacaaacacacaggacacaggaaagagagcaagacccaaaaagagaagcaacaacaaagaggccaacagacaaagagaacgagcaacacaaccgagacaccacgaggaacaacacaacacgagagaaaccaaagacaacaacgaacaaacaaaaacaataaaaacaacacacagaagacac

SEQ ID NO: 443441 - DNA, 1816 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443442 - DNA, 1488 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatgggggaggagcaggaggggggttgggagcgggcagggtgagctccttgttattggtgc

SEQ ID NO: 443443 - DNA, 1867 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccgggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443444 - DNA, 793 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgccccccacgggggccacgcacataccaaagtccacaaaaccaaccattggcgacacccattaacactgtggcaacaacaaaaagaaccaacgtcaggtccagccagcaatttcctaaaaaaagtgcacaaacaagaacgtgaccc

SEQ ID NO: 443445 - DNA, 1124 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgaagatgtgcttggttcagtgcggagagccctgagtcgcattgagcagagcttgagtcgtagaactgtcctttcctggctggggagacagaatctctagccgacatggtttcgtggggagccctatagccattactgcaagatcccagctactccctgaggagctgagtgccctgcacagctggttccagacactgagtacccaggaaccatgtcagcgagctgcagagactgtactgaaacacgaacggtgtcctggctctccgagcttacctccaaaagcagccacagccagccccgctgagggaagggctgtcaccaaatgagcctgaggaggagggacctggcataccctatcctgaggacggacatctgctatggctggcactagcatagggagaccggcccaaaacgcttggccccgcaaggaggccacaagaaaactcaacgaagctgtggcctgcacacagct

SEQ ID NO: 443446 - DNA, 761 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgccccccacaaaaccacctgtccaaaagggccttcgatacgggataatcctattattacctccaaagtttttctcgcagattttctgaacctttacatcagctagccctacccc

SEQ ID NO: 443447 - DNA, 749 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgtgttcatgatcggtgtgtatgcggctgaccacaggctttgtgccccatgtcatgtgggtgaagtgtacccaagccttgtggggccctggggacct

SEQ ID NO: 443448 - DNA, 708 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgaggagcacccggaccccatgtgcacccaaacaacaaaccaccgggaaagcacta

SEQ ID NO: 443449 - DNA, 1016 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgcgcctattctccaggcctacgattagaacctgactatgtacgtcttctgcgcatctttaccactctgatgcacgctcaggcactgaaagggaaaaacgtgacagctaggcgagggagagggggtcggactgggctgtatcgcggcgttgcatggagcccatgtacacagatagggaacttacaccatgcagataactgatttcctgatgtacttgcactgagggatagtccatgacttatagtatacaagacacacgaggaaccagtgggcagtccacactgatcaccatagtatagagtactagagagctgtgtgttacagtagggacaggcggtcacctccatctggatagggagccccg

SEQ ID NO: 443450 - DNA, 885 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccccaaccgggcccatgagacacatatcacaccaagggcccaaaaaaatagaaagcaaccggacatcttggagagccaaaacccggcaattttaagaaccaatgaatgaagaagtacaaaggaagcaaagaataaaaaagaaaagacaaagcgaatagaagggataaccacaatggagtaaaaaagaaaaaagacaatagaaacaaacatggaaaatagataaaaaaaaaccac

SEQ ID NO: 443451 - DNA, 1151 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccagcgccggcacccaggcaaagaccgcacacacatcaggatccggacgaacacgcccgaaccaagagacgcaaacagttacaaccgctgcaaagatcacatggaacacgcagcaacccagcgcgtagacgacaccaacgaactggccgagcaaaccaccgaggattccaaaaacacactgaccgctaacaggccgaaacgaacaaaagaccgacacgcacaaaaccatcggcactgaaccacacagtaaaacagcaaccgcaagccaacgcaaggctctaacggaccccc

SEQ ID NO: 443452 - DNA, 920 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggcgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443453 - DNA, 863 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggtaggtgaagaagcagactgctgcttgcctcctgggctcttttgagtgagggtgttgagtacacagtacctgatgctatgcaccccctatggaaaggctctccttgacctgctgggacatcagattttacagaagtccagagaggggaaggtacctggcctgggctgtgcccatgagaagtgaggggtcccaggtataaatcagaccacatccccctgccctgccctgccctagttgtgtgtgggggtccctccctctcctgctcctagaatactcagaacttctaggggagatcttggaagtcatctagcctgtgtccccctcaattagagatgaggaaaggaa

SEQ ID NO: 443454 - DNA, 828 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaacactccacataccaggaagagaaggaatatactgcaacaaaatataggccagtcatgcaaggcccatggctgaaagtctttcagtcattttagatgaaagactgaaatctttgcc

SEQ ID NO: 443455 - DNA, 740 bp, Homo sapiens
gcctgttgggtgagagtgttgggtcaccctgaacaggcaggtaggtctgccccccatcactattgggcatcgggtgagcactgatgagcattttggacttaggagatattttctctaaccctctagaaaaccaccacaactccaggaaggaaaccaaggggcagacccaaaaaactggtaggtgaagaagcagactgctgcttgcctcctgggctcttttgagtgagggtgttgagtacacagtacctgatgctatgcaccccctatggaaaggctctccttgacctgctgggacatcagattttacagaagtccagagaggggaaggtacctggcctgggctgtgcccatgagaagtgaggggtcccaggtataaatcagaccacatccccctgccctgccctgccctagttgtgtgtgggggtccctccctctcctgctcctagaatactcagaacttctaggggagatcttggaagtcatctagcctgtgtccccctcaattagagatgaggaaaggaagccatagggggaaggtttgtccttcctatgagcctctgcagaagagaaacagcgaaggagctgggccctgggaggggtcggtgctggagttctgatgtgacccaccacactgcactggagggcaccatccaattctgggtccccaaacagctggtggaaaggctcggtgggctgagtcaagaagctgcctctagggggccactgcagttagggtcacc

SEQ ID NO: 443456 - DNA, 715 bp, Homo sapiens
  misc_feature (4)..(4): n is a, c, g, or t
  misc_feature (38)..(38): n is a, c, g, or t
  misc_feature (631)..(631): n is a, c, g, or t
  misc_feature (635)..(635): n is a, c, g, or t
  misc_feature (641)..(641): n is a, c, g, or t
  misc_feature (647)..(647): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccagcgggccagnactnccaggncacatnacaccgcttggcgcaaccataaactggactaacacaaaaaaagaaaaaagtgaggcccaggagagggg

SEQ ID NO: 443457 - DNA, 1849 bp, Homo sapiens
gggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443458 - DNA, 1811 bp, Homo sapiens
tggcgcgggcgggcccgtcccccctgcccctgggtcgctctttttaagctcccctgagccggtgctgcgctcctctaattgggactccgagccggggctatttctggcgctggcgcggctccaagaaggccatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443459 - DNA, 604 bp, Homo sapiens
tgttggaactagtccctttgactccccgtttctattttattttcttctggggctttattttgcggggaggggacggagggagggggctttcttcctctcccccgcgcccgcgcgcgccaggtttcctgccccaaggcgggcttgggtgccccctctggcaggaagtggggccgggtgcacccgcgtggcggtgcatgcggtcggggtgcgctgctttcccgcgcctgcaggagcggcctgcgcccctccccccgcgcgccctggccccgggtcccgccggccggcctgcaacggccgggcgcagacacttgcagagtcaccctcgggccgggtctggagcctgatgcctcgggggtttagccctagccgctaggcgggtaggcaaagtgtcgggttgaaagggtctccgggaacctacttcttcctgctcgccaacttgctgtgtgaccttaggcaactcaaggcttctctgggctacttttttacgggggacggggaagaaaacaagggaacccccaagataatttcctagggcctttcctgcagagtccttaagtatttgaggagcacagtttgcatgcacagtgtatggaggagacaggct

SEQ ID NO: 443460 - DNA, 1918 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443461 - DNA, 2024 bp, Homo sapiens
  misc_feature (4)..(4): n is a, c, g, or t
  misc_feature (38)..(38): n is a, c, g, or t
  misc_feature (1939)..(1941): n is a, c, g, or t
  misc_feature (1944)..(1944): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggcaacaaaaaaaaaatcgggannnatntgggggggaacaggtttgatggcaggcattgtgtccgacacttttgtcaagggaatgcggcccaggagagaaaaaacggc

SEQ ID NO: 443462 - DNA, 2135 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaaagatgagcgatcaaacacacacagccacattttgttgggcgcactctcgcggacccctgagaaaaaagctttgtaaacaaccaatccgggtttggagcgcgcggggggccccattggggtgttgaggagacacgtgggccaaaacggtgttcctagggaaaaaacgcggggccaaacaaaggctgcgggaatctccccagcattaaag

SEQ ID NO: 443463 - DNA, 2244 bp, Homo sapiens
  misc_feature (4)..(4): n is a, c, g, or t
  misc_feature (38)..(38): n is a, c, g, or t
  misc_feature (1977)..(1977): n is a, c, g, or t
  misc_feature (1983)..(1983): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaaaaaaaaaaaaaaaaaaaaaaaaaaaaaaaaaaaaaaaaaaaaaaaaaaanaaaaanaaaaaaaaaaaaagaaaaaaaaaaaaaaaaacaaaaaaaaaaaaaaaaacccgggggccttcatattgtcgggcgggggggaacaagaaggctaatctggaaacgggcacccggggccccaacacgccggtggttccgtggaaccccattttttttggtcaccagggggggacaaactcggcgggcccccccaaaaagagagggcggcaaaaattgcaaaaccccgggttaacccggttttagagctgcgcgaaaaacaca

SEQ ID NO: 443464 - DNA, 1885 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443465 - DNA, 1579 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccaccagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443466 - DNA, 2127 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443467 - DNA, 1926 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccggccccgacaaaaaaaacaggaaaaaaaataaaacaacgaaaaatggaagagaacaaaaaaaataaaatagggcactaaccagcaaaaaacacaaaaagagaagacgctgcacgacacccatgggatgaatgcgaagacaaaaaccaagggaaccagaacaaaaaacacaaagaacaaacaaaaaacacaaagaacgcagcagaagaaaacaaacagagagaaaaaacgaaagaacaaccaaaaacagaagacagaaaaaaaaaaaaaaaaagaaaaaaaatatattgcggaggtagcgaggctggtgtgcttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443468 - DNA, 1992 bp, Homo sapiens
  misc_feature (4)..(4): n is a, c, g, or t
  misc_feature (38)..(38): n is a, c, g, or t
  misc_feature (1725)..(1725): n is a, c, g, or t
  misc_feature (1731)..(1731): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaaaaaaaaaaaaaaaaaaaaaaaaaaaaaaaaaaaaaaaaaaaaaaaaaaanaaaaanaaaaaaaaaaaaagaaaaaaaaaaaaaaaaacaaaaaaaaaaaaaaaaacccgggggccttcatattgtcgggcgggggggaacaagaaggctaatctggaaacgggcacccggggccccaacacgccggtggttccgtggaaccccattttttttggtcaccagggggggacaaactcggcgggcccccccaaaaagagagggcggcaaaaattgcaaaaccccgggttaacccggttttagagctgcgcgaaaaacaca

SEQ ID NO: 443469 - DNA, 2155 bp, Homo sapiens
  misc_feature (4)..(4): n is a, c, g, or t
  misc_feature (38)..(38): n is a, c, g, or t
  misc_feature (1945)..(1945): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctggaaaaaaaaagaaaactacggacaaaaaaaagaaatcgtcgggggcttttttttgcggggggggggagaaaagggttactagaaagggcactggctaatggtgttccctggaccgctttcctggtccaanggtgaaatctcgagggcccccatagaagacggaaaattgcagaagcagggtccgtgataatctcgaaaacaacagaaccaacagacgcaaagcgcgagcacaatcttgctcaacacggtgcacaacactcaacccatagaaaatacataagacaaaagaaagaagtgagaagaaaatacagacagactagacacgtaagcagcgaaaaat

SEQ ID NO: 443470 - DNA, 1878 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcacttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 443471 - DNA, 1065 bp, Homo sapiens
  misc_feature (4)..(4): n is a, c, g, or t
  misc_feature (38)..(38): n is a, c, g, or t
taanataggctaggtacgaggctgggttaaattcggcngagggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaggggctggggctatctgtcaggacagatgactctgaacggctgcaagacggtgcctctccttctcctatggagcctcgtcgggggcacggacagcggacgggtccaaacttgcgtgctgtccctcgaggcttggcactgatatctccagggctgggttgatcaagcagacagggggaaggaatggtactgaggacagtgagg

SEQ ID NO: 443472 - DNA, 536 bp, Homo sapiens
gtcagggaactgctcgctgagcacagctgcacagtgctgtcagaacggccgatctccagcccaagatgattccagcagtggtcttgctcttactccttttggttgaacaagcagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactgga

SEQ ID NO: 443473 - DNA, 457 bp, Homo sapiens
ggaaggccggtggggggaggggggtcctgtggaggtgggaggggcctctgatggactccagctcctgatcgccctttgactcccatctccagggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactgga

SEQ ID NO: 443474 - DNA, 570 bp, Homo sapiens
gtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgatggagtctccctctatcaccaggctggagtgcagtggcatgatctgggctcactgcaacctctgcctcctgggttcaagagattctcgtgcttcaccctcccgagtagctaagactacaggcaccaccatgcccagctaattttttttgtatttttagtagagacagggtttcactatgttggtcttgatctcttgacctcgtgatctgctcgcctcagcctcctaaagtgctgggattacaggtgtgagccaccgagcctgacctggaagtaactcttttaaagataaagtgggaataaactttt

SEQ ID NO: 443475 - DNA, 628 bp, Homo sapiens
gtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactgga

SEQ ID NO: 443476 - DNA, 494 bp, Homo sapiens
ctccctctcggtctctgggtgcggcctgttccgtatgcagtatgtcctcgccctcctctagtgttctctggagtccacctgcgagcgtccgctcttgccaccggtcgtcgttcagatggggtgtgactgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactgga

SEQ ID NO: 443477 - DNA, 543 bp, Homo sapiens
gtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccagcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactgga

SEQ ID NO: 443478 - DNA, 934 bp, Homo sapiens
gtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatacaccagtggttcctcctccctgttaaagactaatgctcagatgctgtttacggatatttatattctagtctcactctcttgtcccacccttcttctcttccccattcccaactccagctaaaatatgggaagggagaacccccaataaaactgccatggactggaaaaaaaaaaaaaaaaaaaaaaaaaaatttgtgggggggctggggcccgcgaaaaggtttttaaaccctatcgcgtggggggagcggcgccccagatggtgtaagctggaacagggggcaaaacggtgctcctaaaggaaaaacgctgggccaacgagaacaagggggcgtggctttccgcaccaattaaaaaaacgcgcgcgggggagccccgcagcgtttcgtgaacccacttccacgtggggagctccggacggcacagacggggctctcataagaggggtcccaggggagtccgattccaatc

SEQ ID NO: 443479 - DNA, 1257 bp, Homo sapiens
gggaaaggagtgtttcccagacagcccagcacctgcaggggatggagggcacataagtttgaatataaagtttaacaaatcaggggcagggcagaggaaccaagtccaagctcttgggttcaactataaagtaccatggaagtttgaaaactgaaagagatcaaaaagctgttagaagaaaacgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctggataaaggacttgtattaaggaaatacaaggaactcaactcattaacaggaaagacaacccaattttttaaaagggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatggcccaaaagtggaaaacaaccccaaatgtcccatcaacaaagtggataaacaaaacccgtaggctgccccagacaatggaagacgattcggcctataaaaaggaaggaagcactgacacccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaaaaa

SEQ ID NO: 443480 - DNA, 1355 bp, Homo sapiens
gtttgttgaggtgggggtcagggggaagaagagtcaagtgaaatcttttccctcatttctgtcaccaaactctctgagcacagctcagaaaggtgggaagcttttgctcttacttagcatcataaaggacttgggaagtggggttcagttaccttagctaaaagtaataaaatgagacaaaaatcagtttcaaggaaccaagtccaagctcttgggttcaactataaagtaccatggaagtttgaaaactgaaagagatcaaaaagctgttagaagaaaacgcaggcatcaatctttatgaccttcgattaggcagtggtttcttagatatgacaccaaaagcaaagcaacaaaagaaagaaaacttaaagtggatgtcatcagaatgaaaaactcttgtgcttcaaaggataccatcacattttataattcatagatctggataaaggacttgtattaaggaaatacaaggaactcaactcattaacaggaaagacaacccaattttttaaaagggatttgaacaaagacttctcaaaagacaaatggccaaaagcacatgaaaaactactgagcgtcttttcataagggaaatgaaaaccaaaaccacaaggagaccatttcctatctactaggatggctaaaatttaaaaagacagtaataggcattatgtagaaaaactggaaccctcatacactgctggtaggggacagcccctgcaaaccttttgaagaactgccagcccctgttccccttttgaggaacagtctggcagttcctcaaaaggttaaacctagagttaccagatgacccagcaattccacccctagttatctgcccaaaagaaatgaaaacctgtctacacagaaatttgtacacaaatgttcacagcagcatgaatcataatggcccaaaagtggaaaacaaccccaaatgtcccatcaacaaagtggataaacaaaacccgtaggctgccccagacaatggaagacgattcggcctataaaaaggaaggaagcactgacacccctacagcatgaactctgaaaacatgcttggtgagagaagccagacacaaaaggccacatactgtatgatttcacttatatgaaatgtccccaataggcaaacccatagaaacggaaagtacattagtagctgtttaggtctgggggagaggggaaatggggaacatggaatctccttctggggtaacgaagatgctctgaaaccgattgtagcaacagttgaacgattctgtgaataactaaaaaccactgaattgtacactttaaatgggtgaattgaatggtacgtaaattatgtcaataaaacttatttttaaaaaaaaaaa

SEQ ID NO: 443481 - DNA, 498 bp, Homo sapiens
ttgtcttatgactacttttgttttatttaatagcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443482 - DNA, 493 bp, Homo sapiens
attttgtatgtatgcctgttaattttcaggtaattcatagtaggattcattaaagcaagtatattagtctttgttatatgttaggtgtatttttgattctcaacaggaattctaatttgtttttcttttctctgaatacagtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443483 - DNA, 296 bp, Homo sapiens
ctaagataatgtcctttcattcccttcttaaaagaagcaatataaagaggtgtcctaagatgtcatctgtgagaatttcttttaaactgtgtcatcatctccaaccctatcacagttcatccagattgttatccctctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443484 - DNA, 1299 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443485 - DNA, 1275 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccattaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443486 - DNA, 1257 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtataaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443487 - DNA, 1149 bp, Homo sapiens
tagaagagtgcctggcacatcctggtggttcacaacaaatatttgttgaaaaaaatcaatgaattgactctggcttttgcaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443488 - DNA, 1200 bp, Homo sapiens
cggcgggagcgctgcaacggcggtgctaaggacacccctcagagcatagatgagggaggctcacgcatctctttgctcatatacatggactctctgtatggcctgcaaatcacatttacttctcctcttatagagactattatctttaataaagcactggatataaatcaaagaaaaaaatagaaaaattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443489 - DNA, 1524 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctgacatagcctctgcctctggaccagggatagtacctcaagcctgtaatcccagtgctttgggaagccaaggcaggaggattgcttgagcccaggagtttgagaccagcctgggcaacatgacgagaccccatttctacaaaaaatttaaaaattagctgggcgtgtgcatgcttatagtcccagctactcaggaggctgagatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443490 - DNA, 1229 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443491 - DNA, 764 bp, Homo sapiens
gcaaactgccatcacacgtgtccccgatggatctgcatgaggctgaacccagtgatgaagtaaaattatcttagaaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443492 - DNA, 653 bp, Homo sapiens
agctcggtacccgactacatacttccgcaggcttggggaaatgttgataataggaaaataatacctttttatcattgtaatgcaaatctcttcaaattataggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443493 - DNA, 636 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaaccttataccttctaaaccagtccacagtagcttctaagtagccaggtttcagccgtttgacatcattgatatcattataattggctgcatcaggatcatccacattaatggcaatgactttccagtcggtttccccttcgtcaatcatagccaatatgcctagaactttcacgccaattatttcacctcttgcacataccttgcttccaatttcacacacatcaatttggtcatagtcaccacaacagc

SEQ ID NO: 443494 - DNA, 398 bp, Homo sapiens
ctcggccgtgtctccccgttgcaaattctttctactagaaatgcttctacataataaaaagcatacattacatataaaagataccagtgtactaaaaagtgacagatgacgaggacgatgacgaggaggaatatggcaacggggaggaacggcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443495 - DNA, 506 bp, Homo sapiens
tgctggaattacaggcatgagccaccacacctagcccaatctcagtttcttaaatccgaacttgttaagatatttgaataaaattgatcacaagaatagctatgccttgccaaaatacataattagaatgttaaatgtaggtgaaaaagctttcgactaaactaaacttgaatatcacctggtcaaccactttcaactcattttttaactcttaagagataatttttgttattttgtcttatgactacttttgttttatttaatagcatgaatacaactttgtctgagagccccttcaagtgtgatcctgatgctgccagagccattgtggatgctgtatgtaaaagtttccttaaaaaaaaaacaagcctggttgctaaaaactatgatgctaaatggggagaggaagtacttgtttcgacaaatacttgagtgccttttgtatgcatgttactgtgtggagtcttgaaattagaaaccatgaacacatgcaagtggccatttga

SEQ ID NO: 443496 - DNA, 1159 bp, Homo sapiens
aggctgcagtgagccttgttcgggccactgcattccagcgtgggtgacagagcgagaccttgtctctgaaaaaagaaaaaagataacctctgtctttttcagtatcttgtacacttctcataggaattatctacatttgccaaactggttgtttcattatgtagccaccagctgtttgcccttacctaacagagattactattgtactgattgttctctgtacttagtgtcagagctattcagagatactagatgattttctttcaatgtatatgtgtatggcttctcttctcaacaaggggcttcgctccaatgttatcttgaacttccgtgataagtcattccacagctctttcaaaataagtacttggaatttttgttgagtgtataattatttgtgcatcttgaaatctgcttattctcttctttctttttaaaaaaatcattctcactgtcatctcatgcttcttctcttcttagatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443497 - DNA, 1495 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaaatagaaaagtggagaagatagaaaaaaagagagaaaaaggaaagaaaggaaaaaatgaaccagggaaaaaaagaagaggggggggggaaataacagagggggggaatgaaaaagttgagaagaggcgaaaagataaaaaaggggggcaaaaggggaaggaggtaggaaaactgggggaaga

SEQ ID NO: 443498 - DNA, 1310 bp, Homo sapiens
gaagcgagtaccttactagtagccactaggggtgtcagtaatatggctcaactttgttacgacggatcagaaaaatgctcacctttaagaccgcaagcagagcctgtctggggaagcaggtgacttatcaacgccttttgagataaggaataggactgcggggaggagtgtgtgagaatcaaagaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443499 - DNA, 1325 bp, Homo sapiens
  misc_feature (24)..(24): n is a, c, g, or t
  misc_feature (68)..(68): n is a, c, g, or t
cgccccacggaaaatgttaactgnaacagcctaataaaatgggcggacccctgggaaggtacaacccngcgggggcgtactcgttactaattcgagttgatcagcaatcgcgaccgatcgcaacggcgcgggcggtcgctgtgctcgggcacgcgcgcaggctcggactatgacgctcacccgatgacgcgcgcgccttctcctgagtacgatcttcttcaaaatgagaagacatatatatctcattcatgatattcaattatgcaataggatgtgtcacatgctatgagtacagctgtctaatgcaaaatgattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443500 - DNA, 1370 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacggtaagatttctattccagtaaaatttcattaaacattacacagttatggaaaaattatgttacttttatttttagttgacaaatgataattaaatatatttatgggtacagtgtgatgttttgatatatgtttacaatgtggaatgattaaatctggctaattacgaaatcattacctcacatacttaatcattatttgttgtgtggtaaaaacatttgaaatctactcttagcaattttgaaatagatgttacagtcaccatcctgtgcaatagatcactaaagcttattccttttgtctaactaaaacttggtaccctttgaccatcgcctgccctttccccatccttcagctcctggcaaccaccattctactctctacctctatgaatttaccttttttatattgcacatataaatgag

SEQ ID NO: 443501 - DNA, 1242 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443502 - DNA, 1079 bp, Homo sapiens
tagaagagtgcctggcacatcctggtggttcacaacaaatatttgttgaaaaaaatcaatgaattgactctggcttttgcaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaa

SEQ ID NO: 443503 - DNA, 605 bp, Homo sapiens
cgccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggaggtaatatttcaccttacatttgagtcagacttaggatattggttttgatctagtcacactgacttgatcaaggatgaaccatctgaacgtcaaggtttttctctgtctggtcccagtctattttctagttgtatctcccattgcctactagtcttccctttgggctccagctaaactcaactgtttacaaatatgccccaaacttttcttcccaacatctttgcttccaatgttcccaaagcctagaattactttttctcctcttactctctgtaagcccttcactgacccctccttagtcaccccagccacagatact

SEQ ID NO: 443504 - DNA, 1330 bp, Homo sapiens
tgaactccatgttctactcagtcctacacagagcaccccaactggcgctggctggtcaacacctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443505 - DNA, 1329 bp, Homo sapiens
  misc_feature (29)..(29): n is a, c, g, or t
  misc_feature (49)..(49): n is a, c, g, or t
  misc_feature (53)..(53): n is a, c, g, or t
  misc_feature (61)..(61): n is a, c, g, or t
gggagcgacgcctggacgaagagtaggtntttttagccttctgggtatnccantcgtattnctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443506 - DNA, 1351 bp, Homo sapiens
  misc_feature (1)..(1): n is a, c, g, or t
  misc_feature (21)..(22): n is a, c, g, or t
  misc_feature (47)..(50): n is a, c, g, or t
  misc_feature (76)..(76): n is a, c, g, or t
naaaaaaaaaaagggggaaannaggaggggagaaaggtaataataannnntttgtggtaacagttgaaaagccttncttgcagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443507 - DNA, 759 bp, Homo sapiens
  misc_feature (56)..(56): n is a, c, g, or t
  misc_feature (708)..(708): n is a, c, g, or t
  misc_feature (738)..(738): n is a, c, g, or t
ctcccgcccccccgaccgtctccgtcgggggggggaggaggaaacttcactgtaanaacctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatgncctggggatcaatatttttgtttctttttnaagtcggtggtttaaggtcac

SEQ ID NO: 443508 - DNA, 2578 bp, Homo sapiens
agggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443509 - DNA, 2477 bp, Homo sapiens
tgtccctttacacttgcttggtggagataactcttcccttccatttagaagaaaacgtaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443510 - DNA, 1657 bp, Homo sapiens
agggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443511 - DNA, 1322 bp, Homo sapiens
ctcttcgttcttcatcctctcctaataggaaaagtgaagtgttcactgtaacccctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443512 - DNA, 1434 bp, Homo sapiens
tgaagacttcactgaaagtgttgaagctgatacattgtaacaagaaggttataaatcttgcagcttggatataccaccaagacaagatgctgagcacagaatcaccctgctgttgtctgtcagcattctccctccctctacgtctttcccttcccacggagagcagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443513 - DNA, 1656 bp, Homo sapiens
agggtgagagctcattttctgtttgcacaattgcctggctcctctggccaaagggtgctctgcttctggcagctgaagatcccagtagacagcttcttaaaccatggctttccctgcaggatttggatgggcggcagccactgcagcttatcaagtagaaggaggctgggatgcagatggaaaaggcccttgtgtctgggacacatttactcatcagggaggagagagagttttcaagaaccagactggcgatgtagcttgtggcagctacactctgtgggaggaagatttgaaatgtatcaaacagcttggattgactcattaccgcttctctctttcctggtcacgtctgttacctgatgggacgacaggtttcatcaaccagaaaggaattgattattacaacaagatcatcgatgatttgttaaaaaatggggttactcccattgtgaccctctaccactttgatttgcctcagactttagaagaccaaggaggttggttgtcagaggcaatcattgaatcctttgacaaatatgctcagttttgcttcagtacctttggggatcgtgtcaagcagtggatcaccataaatgaagctaatgttctttctgtgatgtcatatgacttaggtatgtttcctccgggtatccctcactttgggactggaggttatcaggcagctcataatttgattaaggctcatgccagatcctggcacagctatgattccttatttcgaaaaaagcagaaaggtatggtgtctctatcactttttgcggtctggttggaaccagcagatcccaactcagtgtctgaccaggaagctgctaaaagagccatcactttccatctggatttatttgctaaacccatattcatcgatggtgattatcctgaagttgtcaagtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgt

SEQ ID NO: 443514 - DNA, 1323 bp, Homo sapiens
ccaccgtctgcgtcacccggatgcccaacgctcgtcttaacacgcgaaaggcctgctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443515 - DNA, 1319 bp, Homo sapiens
  misc_feature (44)..(45): n is a, c, g, or t
cagccgatgcacctcacgtattgcctcggtgttcacccaggggnnccttcgctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443516 - DNA, 408 bp, Homo sapiens
tgaactccatgttctactcagtcctacacagagcaccccaactggcgctggctggtcaacacctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgt

SEQ ID NO: 443517 - DNA, 1961 bp, Homo sapiens
  misc_feature (143)..(143): n is a, c, g, or t
tactagatcattcggtcaggcgcgaggctgcagtaggtatgtgaccttgttcctaactgtgcccaaagatatcctgtctcatgacatcattgctggggattttcgtcattgcaaatacagaaagcgatccgcgacgcgtcaantgcgtacgtgcagtcacgtgaagcacatgactctcagagtgaggacgcattcatgcatgtgtctcattcatgctgagtatactactgcactacaggcagcattcatagcacgtagactgcgatgtatcaatacttgagacctcgtccccgtctcagattgcctccatgagtcaaaagcaaggctatccatcatcgaggcttccagaattcactgaagaagagaagaaaatgatcaaaggcactgctgatttttttgctgtgcaatattatacaactcgcttaatcaagtaccaggagaacaagaaaggagaactaggtattctccaggatgcggaaattgaattttttccagatccatcttggaaaaatgtggattggatctacgtggtaccatggggagtatgtaaactactgaaatatattaaggatacatataataaccctgtaatttacatcactgagaatgggtttccccagagtgacccagcgcctcttgatgacactcaacgctgggagtatttcagacaaacatttcaggaactgttcaaagctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443518 - DNA, 1343 bp, Homo sapiens
  misc_feature (34)..(34): n is a, c, g, or t
tccttatcaccctttcttccgtccttctcttttngtttgttgatgctgcaccgtaggtcgcgtttgttttcccccctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443519 - DNA, 1719 bp, Homo sapiens
gggcgggaggcggctgaggcctggcgagaattccagcgtggcaggtgtggaccggcagtgctgggggacccagcgcaccctccacagctgctggccgggtgctaacctcctcactgcccagggctggccgcagcagccggctgttccgagtgtggggcctgctgagcccacatccacccggaactcgcgctggcccgcgagtgccctgcgcccgcgcctcttcctccacacctccccgcaagcagagggagccggctccagcctcagccagtccagagaggggctcacacagtgcagggactggccaaagggctcctcaagtacggccagagtggacgctgaggctgaggaggcgccgagagctagccaggtctgctagcacgttgtcacctctcagtaggaactgggcttctagttccattacccaaatagtgaacattatacctgattgctatccaacttgataaagtcaatcttcaagtatattgtgcatggtctcttctggataactttgagtggaaccagggatacagcagccggtttggtctcttccacgttgattttgaagacccagctagaccccgagtcccttacacatcggccaaggaatatgccaagatcatccgaaacaatggccttgaagcacatctgtaggcaagatggctgagaaatacaggagaggcgtctgcttttggaaaggaaatctgctttggtgatgatctttcaggcaatctcaacttacttctttaatcaacatttaatatcaatggatctgtgattaaaaggtctgaatatgtaatgcctcgtgaagtatttaataatggcctttatttgtatttggatcaatgaggtttttaaaaaaaatggaagagaaaaccactaaccttgatttttgtattgcaaaatcagatagacctggaaacataaatttaaatccttagacatttttctagaaaaaaatgcaaagtttataaagatgatacaaccatgatttgcaactgtaacaggagaccatttattataagcgtacctgtttgtgaacttaattattctgattccataagctgtttttgcttaggtgatccactgccatgtgatccataatttttctacataaaaaatcaaagttaaaagtcacattatacagttatgcattcatttcaacaaaatagtgaattgataatctacttgttaatatattcggcccatattttgtgtgtttggacaagtacatctcccttttgcctaatgaacttttgaaaaataataaaataatagaataaattagactttgaatggcaaaaaaagtatttgagtgttgatgttcagtaaaaaacagattcctaatttggcagagtggtgccaaattaaaagctaagtgataagcagggcataatttccacttttgaatgtttctttaaagtttagaaccttaagaacctcatgaaaaaaatacatgaagtgaatgaccaacctcagtgtaagcaaaggtggggtggggatttattaccccggtagttgaaatgtctgagattggtatggggttgactggaattggacattttactgaacttcctaaggtaggggtcaggagtagaggcagggctccttctggcctccatgtctcccctccagcaaacccttcacgtatgtggagtttggtctttcacatccatatttcagtagacttcagtaagcacctagttacccattagactt

SEQ ID NO: 443520 - DNA, 509 bp, Homo sapiens
agagagtgagaagaagccggtgagtgcagcagcacgcagctccaatttcaacgtctcaaatttgatttctcattgaagaacacaaagaccctcaacaaatggagttgccctttttcttattatcgtttaaacaaggacatcagggaacagtttacaaatgggtgacattctcaatgtgccctttagaaaaaagggatggctttgagttatctgcagctggcattttaaagtgggattttcttttctaaccgaaattcttttgcccaagatttgactgcttctgctcaggggtgacatggcattcatgggaatagtggggatgacgcctgctcctgtttggttttgtgtggatgccggtggaggtgagacaagccttctgagggtgccagtgcacgttggtggtttccattccgatcctctgtccctcaggtcccaactgtctcccagtggctgagccccaggcccaaacacctccctgcaaaacgtgacacctgcaagtgtggaaggca

SEQ ID NO: 443521 - DNA, 1203 bp, Homo sapiens
gagagccggcgcgtcattgtcgtcatcgttgcccgaccgctttccgggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443522 - DNA, 1575 bp, Homo sapiens
gagagccggcgcgtcattgtcgtcatcgttgcccgaccgctttccgggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataactaaagaaagaagcaacataaaaaaaatgccaaggaagcagtgtggggggaacttcgggccctggaaaagagtttttaagcaaggaacggggggggggcgggggccccattagaggatagtggggacccttggggggattaagcgggggtccacagaaggagaaaagccctgggggccacaggacaagggggcgcgagagggaataccccacaccaagtaaaaaaaaaggccgcgggggggggacaccgcacacgctgttctgggaacaaaattccccaaaaatgggagagccagagaggggcagacacaacaggggaatttcatacccacacagggggggacccacagagggaggccggaatataaaattcg

SEQ ID NO: 443523 - DNA, 1150 bp, Homo sapiens
gagagccggcgcgtcattgtcgtcatcgttgcccgaccgctttccgggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttcctcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443524 - DNA, 1091 bp, Homo sapiens
gagagccggcgcgtcattgtcgtcatcgttgcccgaccgctttccgggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443525 - DNA, 1155 bp, Homo sapiens
cgggctgcaggaattcggcacgaggaaggccgtgagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443526 - DNA, 625 bp, Homo sapiens
gagagccggcgcgtcattgtcgtcatcgttgcccgaccgctttccgggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttgattctcattaactttagatgggaaataaggttgtatgttgatggatgaattttggcatgatgactgtactctcaataaaggctgaaaatgttgtataac

SEQ ID NO: 443527 - DNA, 715 bp, Homo sapiens
  misc_feature (62)..(62): n is a, c, g, or t
  misc_feature (102)..(102): n is a, c, g, or t
tgagatgtagccgagaccgtgccactgcctccagcctgggcaacacagcgagactccgtctnagtgaaaaaaaaaagaaaagatacgtgcctgcggtgaggnagctgggcgcatgttttcgagttcagtcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443528 - DNA, 444 bp, Homo sapiens
aaaattgataatagggacactactcaaaggctgttgaaataatctagtcagtgagaatagaggaaagcttgtggtgtaaggagattaagggagccatattgacaggactgattggatttggggtgcctcccaggtttctgcctggattggccaccctgaagtggagaattaaaggaaagaggtagctgatgacttcagttctgtatgtgatgctatgcactcttgttttctcctatcggtactttggcttctgtataaccagtgagaggaaggactgagtggcagtaacatctgttagggttactgggcagcatccccgcaacccaggtactcagtctcagccacaccttactgagtggtgaagagaagcaagttttctcatgccctctccgtctgtctctacctctgcagccagtgttttagaaggagtatgtggaagggcaa

SEQ ID NO: 443529 - DNA, 1280 bp, Homo sapiens
gagagccggcgcgtcattgtcgtcatcgttgcccgaccgctttccgggagactggagtcgaaggccgtgaggtatttttctaagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443530 - DNA, 1227 bp, Homo sapiens
gagagccggcgcgtcattgtcgtcatcgttgcccgaccgctttccgggagactggagtcgaaggccgtgaggtatttttctaagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttcctcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443531 - DNA, 1429 bp, Homo sapiens
gagagccggcgcgtcattgtcgtcatcgttgcccgaccgctttccgggagactggagtcgaaggccgtgaggtatttttctaagtgagaggaaggactgagtggcagtaacatctgttagggttactgggcagcatccccgcaacccaggtactcagtctcagccacaccttactgagtggtgaagagaagcaagttttctcatgccctctccgtctgtctctacctctgcagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataac

SEQ ID NO: 443532 - DNA, 927 bp, Homo sapiens
gagagccggcgcgtcattgtcgtcatcgttgcccgaccgctttccgggagactggagtcgaaggccgtgaggtatttttctaagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatctttccgtcattttttcccccggcccgggaaaaaaaaattgtgggggggaggagagtgcaaagggtgtccaataaaagtgtatcatccagacaagatgtgaaggagatttgtgcgcgagaaaaaaatttttgagtggagcgggggaaacatgtgtaattatttaataaaccctggtgagattaattataggagggaaacttacgaaggaaagaaagctgaagtggatagaagatatactggaaagatggcagttaagaaagtctgaaattgacgatggagattgttaacaggt

SEQ ID NO: 443533 - DNA, 5240 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443534 - DNA, 4973 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaagatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443535 - DNA, 5026 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443536 - DNA, 5568 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaaaaaaaaaaaaaccccacaaacacaacacacaaacacaaaaaaacactttttggcgcccccgcggcgcccccacgaaaggttttagaaaaccactacggtagggagacgcagcggggaccaccaacgaggcacagagagacaagcggtcccacaaggattgggtttcccacgagaaaacccgcggtcctgacaacgagggtggaactcacacagcacaataaaaaagcccgggtggcaccccgaaactttgcgaaacacatccgagggacatcttgcgaggccaacaggggcactaaacaaggggagccacaggacccaaacaatgcgg

SEQ ID NO: 443537 - DNA, 5472 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaaaaaaaaaaagaaaaaaaaaaaaaaaaactttgttgcggccgcttgggccctaaaagtttttaacaccttcggtggggcgcggggcccaagtgtgttgtcgaccttggccatagtgcccaaggaaatcgtgggccgaacatggggtgggtccccccaataaaagccccgggggaccggcggtcggacaacccagatgggtctggggcctcggacttcacggtccaggcgtagg

SEQ ID NO: 443538 - DNA, 4554 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggtaagttacacgttacacagacatagataaaaacatttccctttatcaggaaaatgtcagattgattcattaaaatatgtgatacataatgaaaagctaagtatttgcactatggcttttaaatggaaaaactgaaacaaatcactgggtttaagcactagaacacatgtgtatgtttattcacatatgtagaaattcttcaatatctgaaatatttgattaaccccagggcatactggtagagacaagagtctatgattatgttttccagtgtttatttaaatgacgctaaggacattgaaggagaagct

SEQ ID NO: 443539 - DNA, 1057 bp, Homo sapiens
  misc_feature (12)..(12): n is a, c, g, or t
  misc_feature (34)..(34): n is a, c, g, or t
aagggtggctcnattgaacaagaatccccaaatntcattaaattcattgcgacccatggggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443540 - DNA, 657 bp, Homo sapiens
gtttcactatgttggccaggatggtctcaatctcttgacctcatgatctacccgccttggcctcccaaagtcctgggattacaggtgtgagccaccgcacccagccaaagtgtatactttctaatatctatacccagttatctttgatgatttaactgtatttttataataacgtaaaatatcttatttttttatcttatgccttactattttgtcctcataaatatcatattaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtgagtattacattctgagttttacttttatggagttcaaagtagtagttaaacaaaatagagacggtatagactagcaacaacagttgctatagtaacagtttaaatttctgtggcttaagtttgatgttgtctcagttagaatatgtactctatattgaatttgtagatagaagatatagag

SEQ ID NO: 443541 - DNA, 186 bp, Homo sapiens
actgcctttatatttatacaattttataaattaattcatgttcacaaaagctactccaaatctgtccttttaaacattttatctagccatgaggagcttcgttgcacattgtcctgagctactaactgaagatgtgattcgaaaattgatgacccctattgaatgtgccatgactatgatgtcaca

SEQ ID NO: 443542 - DNA, 729 bp, Homo sapiens
acttattctggtaagccattaccaactatgtttttgatattttagcattccatctgtaatgaaagcccatggagctcatctgaaagctagtgctgcaatggtccgtttaagactttatgatatcttggctttgttacctccaaaaacttatgaaggtaaattaaaaatttgtggtatctgataaaaatttttctttacaattcttcaccgtattatagagtcttgacaaaggctctcccactgacttactgtgcaaaggaaggccaccattttatttttcttcatgtagagtagctgatacttgttgactccttactgtgttctgggtctcgttttcagccttttgtattagctttttgactgtgttgcaacttatgaggcctttagccctattttatagatgaagaatctcagattgagagacttaaagaaacttaacttacccaagacttagaggtagttaagtggcagagcttggattcaaatctagctggtttatcttcaaagtgtgcacttttgattaatacactgaaatgcttcctatatactgtaatatagcaaataattcgaggatctggagggagaaatcaaatattatgtaaaatattaatagtaaaataaactattgatttctttccagtataatcatgccaaagaattttggtgtgctgtggttcattgtacattattgggcaataaataataataatcatatcacatttaatatat

SEQ ID NO: 443543 - DNA, 3460 bp, Homo sapiens
agcttattaaagacttaatgcccaatgtttttattgggggctgatgccataggcatggcctgcctggcacataccaaaagttcggactcagaaggaaagcagatgttcaacagaagccacagtttagatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443544 - DNA, 4860 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443545 - DNA, 2562 bp, Homo sapiens
agcctgtggcaccagggaacatgcaacaataagacagtcgagatggttcttgagaggactaagacaatgctggaaatcgtgcttacacactgctcggccgtgagagtgcgactaccatggaaaagctggctgatttcaaagctggtgcatatgtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacagagtccagctacttgctcttttagttcccactttgatatcttacctgctggatgaaaattcttttgcctcagcaagttcagcttccaaagatcttcatgagtttgcactccagaatttaatgcatattggacctctgtatccacatgctttcaagacagtaatgggggctgctcctgagttgaaagtgcgtctagaaactgccgttcgagcaagccaagcgagcaaagctaaagcggctgccagacaaccagcccccgccatacattctgcaccaacaattaagctaaaaacaagttttttttaatttgtaatttcatttatttgtatttatgttgtcaactagcccctaattagtgatggccactgtatcattccaggctacctatgggttctgttttatttgtatattggtattatagtgcttccaagtaggttaagtgaaataatgctcacaccacttattgatttttaaggagtgattttttttatcatgtggtgaatatgttttcattttcctcctaataatgtttctcttttgttaacttatttatttttcaaacactgagccatagtcttaaatttaaatgctaaaaacaattgtatcatgtagtcgggcagcctattgatactgtcaggggaaaaaaatgggtcagaactcagcatctgtcatgaaaaaaatcaattgaaaaacaagcagattttaaattttgaagtaatcaaaataatggaaagtgtctgttttgtggtgtatatactatgaataaaatcacagcattttctaa

SEQ ID NO: 443546 - DNA, 4673 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccagaagactctgtacctacacctgatgaagtaagcatgctaacagcaattgcactcttcctgtggtctgctagtaatgaaataataggagtccagtcattacagaatggctgcatgaacagatttaaaaatgcattaaattcatgcgacccatgggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacattctaggtagtcagcctgaatctactttacgttccctgcctccagaccctattctcctgcctcctgcccacaactcccaggctccagtgatctacccgcctcggcctcccaaagtgctgggattacaggcgtgagccatggcgcctggccaaaatgtaaatgagtcctcgtaaagcaaaaaaagtattgtgagtaataaagttgaactacgaatta

SEQ ID NO: 443547 - DNA, 4521 bp, Homo sapiens
caggtgtgcagaacggctcaacaacttgaagacctcaccagaagctgtcagtggatatagttttgcaatggctgctttgttaggtggagtacatcagtgtcctttgggcattcctcatgccaaaggaaagatggtagttagtattgctgaagatcttttacgaactgctgcccaaaatagcaggctatctttacagcgcacccaagctggctggcttttacttggagcacttatgactttaggaccatctgtcgttcgttaccatctgcccaagatgttgttattgtggcgaaatgttttcccacgttccttaaaggaattggaagctgagaaggcccgaggcgattcttttacctggcaggtaactttggaaggtcgtgctggagctctatgtgccatgaggagcttcgttgcacattgtcctgagctactaactgaagatgtgattcgaaaattgatgacccctattgaatgtgccatgactatgatgtcacacattccatctgtaatgaaagcccatggagctcatctgaaagctagtgctgcaatggtccgtttaagactttatgatatcttggctttgttacctccaaaaacttatgaaggatcttttaatgcacttcttagagaactggtagcggaattcactttgactgacaactcagccaacacaactacttccctcctcagatccctctgccattatgatgatagtgttcttcttggttcttggcttcaggaaactgatcataaatcaattgaagaccagctccagccaaacagtgcctctggaagtggggctctggagcatgatccttcctctatttatttacgcatacctgctggagaagcagtacctggtcccctccctctcggagtctcagtcattgatgcttctgtggccctttttggtgtagtgtttcctcatgtttcttataaacaccgattacaaatgttggatcactttgctgaatgtgttaaacaagctaaaggtgtccgccagcaggctgtgcagcttaacatatttactgctgttcttagtgcactaaagggcttagctgaaaacaaaagtactttaggacctgaggaagttcgtaaatctgccctgacactggttatgggtcctctggacaacccaaaccccatcttacgttgtgcagcgggggaagctcttggaagaatggctcaggtggttggagaagcaacttttattgctagaatggcccaatatagctttgacaagttgaaatcggctcgagatgttgtatctaggactggtcattcattggctcttggttgtttgcatcgttatgttggtggaataggctcaggacaacatctgaagaccagtgtcagcattttattggctctagcacaagatgggacatcccctgaagtccagacttggtctcttcattcacttgctttgatagtggattctagtggtccgatgtatcgtggctatgtggaaccaacattatctctagttcttaccttgctgttgacagttccgccttcacatacagaagttcatcagtgtttgggtcgatgcttgggtgctataataactactgttggccctgaactacaagggaatggagcaacaacttctacaattcgttcctcttgtttggtgggttgtgcaataacacaagaccattcagattctcttgttcaggcagctgccatatcttgccttcagcagcttcacatgtttgcaccacgacatgtcaatctatctagccttgttcctagcctttgtgttcacttatgtagttcccatttgttacttcgacgagcagctgtggcatgtcttcggcaacttgcacaaagagaagcagcggaagtatgtgaatatgccatgagcctggcaaaaaatacaggggacaaagagagcagtagtgccaatgtcagtccttttgcccctggggttagttctcgaactgatatccattgccggcaccaaggtgttaatataacagaaactggtcttgagggacttctttttggaatgctagaccgggagacagatcgaaaattatgttctgatattcatgacactttgggacatatgctttcttcgctggcagtagaaaaactttctcattggctaatgctttgtaaagatgtcctggcagcttctagtgatatgagtactgcaactctcttaagtagtggaaaagatgaagaagctgaaaagaaagatgagatggatgatgataccatgtttaccacgttaggtgaagaagataaatcaaagccctttgtggcccctcgctgggccactcgagtatttgctgccgattgcctgtgtcgaatcatcaatttgtgtgagaatgcagaccaggctcactttgatcttgccttggcacgttctgctaaacttcgaaaccctacaaatgacctcttggtacttcatctctctgacctcattcgcatggcattcatggctgcaactgatcatagcaaccagctgcgaatggctgggctccaggcgcttgaagacattatcaagaagtttgcgtctgtgcctgagccagaatttccaggtcatgtgatactggagcagtatcaggctaatgtgggagctgctctaagaccagccttttcacaagatacaccatcagatataatagcgaaagcttgccaggtatgtagtacatggataggaagtggagttgtcagtgatctcaatgatctccgtcgagtacacaatcttcttgtttcttctctggacaaagttcaggctggaaaaggatcttccagccagctgtaccgagagagtgccacgaccatggaaaaactggctgttctcaaagcttgggcagaggtatatgtggtcgctatgaatattaaaaaggaagcagagtcaaaaccaaaaagagcaattaaaaatactgacgatgatgatgacgactgtggtaccatcgatgaactgccaccagatagtttaataacactggtacaacctgaactaccaacactcagtcgcctgtggttagcagcattaaaagattatgcactcttgactttaccagccgaattttctagtcagcttcctccagatggtggagcattttatacccctgaaactattgatacagctagacttcactatcggaattcctgggccccaattctccatgcggtggcactttggttaaatagcacaggatttacgtgctcagagtctacagaagcagcagcaatatctggtttacaaaaacgttctacatctgtcaatttaaaccaggcatcaggagcagtgggtagtgctaaatctttgccagaaattaacaaagacagaatgcatctgattttaggtgtgagtatacagtttctttgttcccctagacctgaggagcccattgaacatgttacagcatgcctgcaggccttacataccttgctagactccccttatgctcgagtccatattgcagaagatcagctgataggtgttgagttgctgagtgttttgcaccgccttctattgacctggaatccatcatctgtccagctgttggttactggagttgtacaacagatagtaagagctgctcaggattatttgcaagagaaaagaaacactctaaatgaagatgatatggaaaaagaggcctgtaccgtattgggagaaggaggtgacagcggtggtctcattcctggaaaatctcttgtgtttgcaactatggagctgctgatgttcattttagtacggcatatgccacatctcagtaccaaggtgtcagactctccaagtcacatagccactaaaactcgactatcagaagaaagtgctcgtttggtggcagccacagttaccatactctctgatttaccatccctttgttcacccgctggatgtatgacaatcctgcccacaattctgttcttaattgcaagaatattgaaagacacagcaataaagtctgcagataatcaggttcctccaccagtcagtgcagctcttcaagggattaaaagtattgtgacactttcaatggccaaaactgaggctggcgttcaaaaacagtggacagctctgattcgtagcacgcttgcttgcatcctggaatattctcaaccaggttcaagccaaatgttaccagcttctcctctcagtcttccagcattccaatcgtgccctttcaactccttatattcattcattagctccaatagtggttgaaaagctaaaagctgttgaaagaaacagaccagccagtaacatagagcttttagcggttcaagaaggaataaaagttcttgaaacactggttgctcttggtgaagaacaaaacattctaggtagtcagcctgaatctactttacgttccctgcctccagaccctattctcctgcctcctgcccacaactcccaggctccagtgatctacccgcctcggcctcccaaagtgctgggattacaggcgtgagccatggcgcctggccaaaatgtaaatgagtcctcgtaaagcaaaaaaagtattgtgagtaataaagttgaactacgaatta

SEQ ID NO: 443548 - DNA, 853 bp, Homo sapiens
aaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagagagaaaaagtgggggggtgcacttatagtcccagctacttgggaggctgaggtgggaggatcacttgagcccaggagtatgcgtttagcctgggcaacatatgaaaccccatctctttttta

SEQ ID NO: 443549 - DNA, 896 bp, Homo sapiens
aaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagagagaaaaagtgggggggtgcacttatagtcccagctacttgggaggctgaggtgggaggatcatacttccttcccagttctagattagtctgggcgacacagcaagaattatttctatcaaaaagtcaaaaaagaagtcgatcaaaataataatgtaacatctac

SEQ ID NO: 443550 - DNA, 3683 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443551 - DNA, 3473 bp, Homo sapiens
aagtgccaaaatggcgatgcctaccacctagaactggattgtgcgctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443552 - DNA, 3816 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccatcagggtcttctctgggctctccatgtaccagttacctccgatgggtgaaggtcgggttggggcatccccggggagcaccacttttgcactcggcaggctgtttcccagcgctccatctgctccgtcccacagcagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443553 - DNA, 1724 bp, Homo sapiens
cggcactgcttcggatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443554 - DNA, 1117 bp, Homo sapiens
cgggtgcatgcatgtgggaaggcaaaagcattgtggacaaagaaggtgtccccggttctatatccgcatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443555 - DNA, 945 bp, Homo sapiens
tcatggcccccactacgacaggttcacccgcgaggaaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443556 - DNA, 2926 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccatatccatatccgatccatagatacagtt

SEQ ID NO: 443557 - DNA, 2829 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagcggaaggtctttcccagtgacaaccacgtaggctgggcagggttgtacatcataggaa

SEQ ID NO: 443558 - DNA, 2771 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggaccacaagcccagtggtcacccctgtgtgcgcccgccccagcccaggagtagtcttacctctgaggaactttctagatgcaaatgtgtgtgtgtttatgtgtattttgtaatatgtgagggaaatctaccttcgttcatgtataaataaagctcctcgtggctccctttgtga

SEQ ID NO: 443559 - DNA, 873 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtactcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443560 - DNA, 302 bp, Homo sapiens
aaggtgatgttggctcaagaaagggagatagatggtagcccatcacctttccgtctcccctagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagaggtcggtaacctgccttcccttctcagacccttcaagtgtgttgtgagaagtcagcacatccaa

SEQ ID NO: 443561 - DNA, 3490 bp, Homo sapiens
aagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443562 - DNA, 3747 bp, Homo sapiens
  misc_feature (3598)..(3598): n is a, c, g, or t
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgcccgngatccccaagggtggggaattggtggccactgtttgtatgttcttgagtgcaagtgttttattaaaaaataaaacaataaccccaccattcacaagaaaaaaaaaaatttttgcctctgaaggagtatatggtaaaatatacttgaagg

SEQ ID NO: 443563 - DNA, 2116 bp, Homo sapiens
  misc_feature (25)..(25): n is a, c, g, or t
  misc_feature (30)..(30): n is a, c, g, or t
  misc_feature (48)..(48): n is a, c, g, or t
  misc_feature (66)..(66): n is a, c, g, or t
  misc_feature (106)..(106): n is a, c, g, or t
  misc_feature (117)..(117): n is a, c, g, or t
cgtccccagtctttgggctgggctnggagncagcagcctggcgggaanacagtgcagccccaggtnccagcgctggcaggcgccgcgccctccccactcggctggntgccccccttncccctttcccaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgtcagtggcccgggcgccaactccaagggtggcggtgggggcagggtcaagacccgctccctgagcccgttccttgctcccctgtgctgacttctctgcacacccgcaggcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443564 - DNA, 1539 bp, Homo sapiens
  misc_feature (92)..(92): n is a, c, g, or t
ccagggagatttccgtaacctaagtccaagggaaagtctggcatgggtgttccctcctctccctccccaccctacagtggcacctgagcctncaggtcctctcggccctcccccagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443565 - DNA, 2991 bp, Homo sapiens
  misc_feature (2900)..(2900): n is a, c, g, or t
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccagnccccccgcccccatgagcagctcgcccctgagttagcagctcgctcctgagttagcagctcgcctctgagctgcagctcgcgccctgaggt

SEQ ID NO: 443566 - DNA, 2857 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcgccaaactagaggaggcctgtatgtcccttgattcgactctgagccccac

SEQ ID NO: 443567 - DNA, 2802 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtgtgtgtttatgtgtattttgtaatatgtgagggaaatctaccttcgttcatgtataaataaagctcctcgtggctccctttgtga

SEQ ID NO: 443568 - DNA, 2615 bp, Homo sapiens
caggtgcgagccactgcgctcggccgatactttcttagtgccccagtttaaggaagggcggttcaggagcagagagtctgacaggatcttactttatccctttagctctttttctttcaaattcctctgtctcgcttaaatcttcccgcatcttctcctttctatttaattctgccttccccggttctccttagaacctcatgtccttttctttagctccatttctttcacctcaaagctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagaggtcggtaacctgccttcccttctcagacccttcaagtgtgttgtgagaagtcagcacatccaataacaagcacccctctctcttctgaccttcgcaaacacgctacttgatcactcactcactttcctattcatgcattcactcatctgactcagcaaacatgtactgtgtctctgtggcagaagcgtttatatgccagcacctgctgtgttgtcagaaatgcagaccctaaacagggtctgcccgcagagactcaagttctagacaactagctcccaaaagaacaaagctgtgtgactgtctaggagctaggaacctgtctgtagactttacaggccatgccccacctcctcag

SEQ ID NO: 443569 - DNA, 2571 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443570 - DNA, 986 bp, Homo sapiens
gatgtgacatctaccagggacagaaaatatgtgctcttttcactctgctcagccaggctagagctgtgcctaccccacagcatgtgtttggagcctgagggagacagcagtgtgcattggggtcagataattacagaagcatctcccctccatgttttcctctctcctaaagactttgcttgttaactctgcatttacaggtaaccaagcccatatgatggcattagttaatgactgactgctgtttttttccaagctgctgtcaggcagattttactaattaatttcacttaaaatagtggtgttcaagcctgactgcatagtaaagtcatctggggagcttagaaaaaataaacaaactgatgccagagccccaccccaattaaattctgatttaattggtctaaggtccaagcattgatatgtttgaaaaattccccaggtgattctaataggcagccagggttggaaccatggatctaaaacatcaggaaaagtttcaatgaactaattaattgttttaaaacagttacaacagcattgttttcttcacatctggcaatgtaattcataaaacaataatgaaataatttgcaggatacaatgtcttcataggattttctcattctcatttttgctaagtcaacacatggctgaattaaacaatcaatctgaaaccgatggttccactgaagcttcttatagcttcattaccttctttctccaaatcacatcacaaagatttgatagagtaaccacctacctcgacctttatgttgaggtgtctggacagcacagaggcatggtacttagaaaagattccaggacgctttgttatcattggactttctgtgctatggaaattcaacactgtgggctggaataactagtcatgtggaactccttcctgcttttgtaccctctcacttttacttgagcagaaggttaaaagtattgctttctgagaagtcccattcggtcactcc

SEQ ID NO: 443571 - DNA, 769 bp, Homo sapiens
gtcccttggggaccccttttcccaagtgtcaacaaaacccatggggccccccccccccaaaccaattggttttaaaaactttttccaaggcccaaccgcccacaaaatttttattttttttttttttttttttttgcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgatgatcgaagagtatttgaccaaagagctgctggccctggattcagtggaccccgagggacgagccgatgtgcgtcaggccaggagagacggtgtcaggaaggttcagaccatcttggaaaaactcgacctttatgttgaggtgtctggacagcacagaggcatggtacttagaaaagattccaggacgctttgttatcattggactttctgtgctatggaaattcaacactgtgggctggaataactagtcatgtggaactccttcctgcttttgtaccctctcacttttacttgagcagaaggttaaaagtattgctttctgagaagtcccattcggtcactcc

SEQ ID NO: 443572 - DNA, 2577 bp, Homo sapiens
  misc_feature (5)..(5): n is a, c, g, or t
  misc_feature (7)..(7): n is a, c, g, or t
  misc_feature (13)..(13): n is a, c, g, or t
  misc_feature (20)..(20): n is a, c, g, or t
gaacnanggctangtcgagnccggtgtgaatcggccgaggagttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443573 - DNA, 2586 bp, Homo sapiens
agagtgactaggtgcgtgctggtgttaattcagtcacagggcgcgtgcatttctctggtggtggatcggcagtaccttgccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443574 - DNA, 2876 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaaaaaaaaaaaaaacaaaaataacaaagaatcttttctggcgcgcgctcggcgccctagaaagaggtcttcataacccaatttggtggggcggcgcggggccccaagtgtggtgatagtgtgaccacggcgcatacgggtgtccaaaggagagcatcccggggcaactaagcaatagtgtgtgggctctctccccaataaaaaaccgcgcgggggcgacagcccgcggctgttctggaccacaccccagaggggcgctggcgccataccgcggccatctccagaggtccagcagagcctagttaaaa

SEQ ID NO: 443575 - DNA, 2261 bp, Homo sapiens
tcatgtggcacatgtgataccatgtgaggtatctggtgttactaagtcgtcacgtatttcgatgaagggtccacaggctcagaaaagatggaacgagtgactgtggagaagggtagaacatgggcctgcccagagcgcgaaggcagatacagaagagctgcccgtgaaggatgcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443576 - DNA, 1227 bp, Homo sapiens
  misc_feature (5)..(5): n is a, c, g, or t
  misc_feature (7)..(7): n is a, c, g, or t
  misc_feature (13)..(13): n is a, c, g, or t
  misc_feature (20)..(20): n is a, c, g, or t
gaacnanggctangtcgagnccggtgtgaatcggccgaggagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443577 - DNA, 2252 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttg

SEQ ID NO: 443578 - DNA, 2008 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaactcgacctttatgttgaggtgtctggacagcacagaggcatggtacttagaaaagattccaggacgctttgttatcattggactttctgtgctatggaaattcaacactgtgggctggaataactagtcatgtggaactccttcctgcttttgtaccctctcacttttacttgagcagaaggttaaaagtattgctttctgagaagtcccattcggtcactcc

SEQ ID NO: 443579 - DNA, 1478 bp, Homo sapiens
  misc_feature (1413)..(1413): n is a, c, g, or t
  misc_feature (1461)..(1461): n is a, c, g, or t
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgantgctcatcctcatcctcctcggccagcctgccttcctccggcagggcnagcctgggcagtcacca

SEQ ID NO: 443580 - DNA, 982 bp, Homo sapiens
cagcctgctggggagcaagccgctgtgcttcccaggccgggcccatcccctgaggacagtgccctgggccaggcacctgttcacatgcagggcatctgggtctagcctgcagcatcagaggtcacccagcagagacagggtgatggccccacatcatcccccagcatctcatagggctgttcttcagtggggcagggcaggaatcatgtggcttctttttgtagctaaggaacggctcggaagggcacactgcagcctgcctgctccagatgcacacaggtggagggagcagagctgggaccggaagcctggcctgccttctggcgcctaatttccatgctccttattcacactgggctttctattcagaagcacagagatagctgtgcattattttgttcagttcaatgcttatggataaatcttaaccgcttgtggagctatgttgacaggaaaatgagaccccatgcctgccctcaccgtgcaccacagtttcaaaagaaataaggagtcaggaaggcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgcttgagagtgaaagttacagttaatgtgggataccttttttcttttcttagagaggtagtacctggctgaggcaggtggatcacttgaggccaggaattcaagaccagcctggctcaggtggtccactcacctaggcctcccaaagtgctgggattacaggtgtgagccaccgcg

SEQ ID NO: 443581 - DNA, 414 bp, Homo sapiens
cagcctcctgagtagctggcactacaggcatgcgccgccacacccagctaatttttgtatttttggtagagatggggtttcaccatgttggccaggctgctcttgaactcctgacctcaggtggtccactcacctaggcctcccaaagtgctgggattacaggtgtgagccaccgcgcccagccccagagctctcagtcttaaccgcacattttgaaaattgaaaattacagataggaggtcttacaatatggattgccctgaggaggtgcacagcagaaggcgtggtcaggatgccaagccaggggagtcatttgtggggtcatgccctctaccctgtgtctcttgcagcggtcccagtctccagctgcctctgactgctcatcctcatcctcctcggccagcctgccttcct

SEQ ID NO: 443582 - DNA, 908 bp, Homo sapiens
  misc_feature (5)..(5): n is a, c, g, or t
  misc_feature (7)..(7): n is a, c, g, or t
  misc_feature (13)..(13): n is a, c, g, or t
  misc_feature (20)..(20): n is a, c, g, or t
gaacnanggctangtcgagnccggtgtgaatcggccgaggagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttg

SEQ ID NO: 443583 - DNA, 2787 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaaaaaaaaaaaaaaaagaaaaaaaaacttggggggcgccccgggcccgaaaaaggttcaaacccatccgtggggcggccgcgcccggggtgggacttggccaacgggggcgccaggaaacgtgtcccaccatgcggtggtctcaccaaaaaaaaacgccggggggacggcggtcgcacacccagggggcgggcaacggcatcacagggcagggcgtaa

SEQ ID NO: 443584 - DNA, 2378 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggacagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443585 - DNA, 1643 bp, Homo sapiens
ctccactccttcttggaattcatagacacaagtcactcctcatcatcactgttgcttgagcaccgaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443586 - DNA, 1716 bp, Homo sapiens
cagcctgctggggagcaagccgctgtgcttcccaggccgggcccatcccctgaggacagtgccctgggccaggcacctgttcacatgcagggcatctgggtctagcctgcagcatcagaggtcacccagcagagacagggtgatggccccacatcatcccccagcatctcatagggctgttcttcagtggggcagggcaggaatcatgtggcttctttttgtagctaaggaacggctcggaagggcacactgcagcctgcctgctccagatgcacacaggtggagggagcagagctgggaccggaagcctggcctgccttctggcgcctaatttccatgctccttattcacactgggctttctattcagaagcacagagatagctgtgcattattttgttcagttcaatgcttatggataaatcttaaccgcttgtggagctatgttgacaggaaaatgagaccccatgcctgccctcaccgtgcaccacagtttcaaaagaaataaggagtcaggaaggcagctgctttaagacagcattttaatcctgaagccaaacatctcagggatatgtcaatggattctgtgcattaatagctaaaaaatagttcttaatctggttcttagctgagatttgaggcattcctagtaggattcctaagcagtaagtcctctcattttcctgtctgcacatcatcctgtggtgtgtgccagcgttgttcctgggcacaaactcccgtgtcctatctgcaccctgagtcatgcttgcctctcagctccgtctgaatctgttcagcttcacacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443587 - DNA, 1371 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443588 - DNA, 852 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 443589 - DNA, 379 bp, Homo sapiens
tgagacagaggctcactctgtcacccaggctggagtgcaatggcatgacctcagctcactgcaacctccacctcctaggctcaagcgattctcctgcctcagcctccagagtagctgggattacaggcacctgccaccacggccggctaatttgtttttgtattttttagtagaaacagggtttcaccacattggccaggctggtcttgaactcctgacctcacgtggtccacctgcctcggcctcgcaaagtgctgagattataggtgtgagccactgcacctggccctagcttttgatactgtcatttccctttgggcttgagactgttctagtcaatcctggtctcattgtttgcctgacaggtaccatgatttaa

SEQ ID NO: 443590 - DNA, 4744 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcatgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaaaaaaaaaaaaatacaaaaag

SEQ ID NO: 443591 - DNA, 5328 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcatgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaataatggtgtgttgtcatttgtgctttttcagggtgtttttttggtttgatatcttgaaatatgattaaaacattggcttcctaaaggcagtttccaccagtttgccaaaggatcattgtgtcagcagcaaatcagctgaactttatttccaaaggcaaaatcctttctgattattttagtaacatagtacttttatgatgttgcaaataaatgaagggcccacagcccaagaatgaattaccactgtggttcaacttaggttatttttgtgagctgaaatgatcatatctcagttgaaaactggctaaaatttagggccttaaattaacaggtatacattttatttccctataaatttttgcttttacaatttctaggccaggcgcggtggctcacgcctataatcccaggactttggaaggctgaggcgggcggatcacgaggtcaggagttcgagaccagcctgaccaatatggtgaaatcccgtctctactaaaaatacaaaaattagctggttttggtggcatgcacctgtaatcccagctgctcaggaggctaaggcaggacaatagctggaacctgggaggtggagattgcagtgagc

SEQ ID NO: 443592 - DNA, 4737 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcatgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtggttctgctcattaatcaccacgagtgtggatctgaagaagagtttattacctctctttttttgagtatgtttaacttcagatacacacaacgtagcttctccttccctattagattcttagaagggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaaaaaaaaaaaaatacaaaaag

SEQ ID NO: 443593 - DNA, 1908 bp, Homo sapiens
gccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatcaaata

SEQ ID NO: 443594 - DNA, 2048 bp, Homo sapiens
gccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagaaagaatttgactgatgggcgtaaggaagaaaaagagaccgaggcaagtttcagagaagtagtggaagatttttcaaaaaagctgtagaacaagaaagaaagtatgcttgggaaagacccaagcgggcatgtgaaggaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatcaaata

SEQ ID NO: 443595 - DNA, 1869 bp, Homo sapiens
gccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatcaaata

SEQ ID NO: 443596 - DNA, 743 bp, Homo sapiens
ggtccggaattatagggtagtcttctagtactaaattcgcggccgcgtcgacgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaataatggtgtgttgtcatttgtgctttttcagggtgtttttttggtttgatatcttgaaatatgattaaaacattggcttcctaaaggcagtttccaccagtttgccaaaggatcattgtgtcagcagcaaatcagctgaactttatttccaaaggcaaaatcctttctgattattttagtaacatagtacttttatgatgttgcaaataaatgaagggcccacagcccaagaatgaattaccactgtggttcaacttaggttatttttgtgagctgaaatgatcatatctcagttgaaaactggctaaaatttagggccttaaattaacaggtatacattttatttccctataaatttttgcttttacaatttctagccactgcacctggccctagcttttgatactgtcatttccctttgggcttgagactgttctagtcaatcctggtctcattgtttgcctgacaggtaccatgatttaa

SEQ ID NO: 443597 - DNA, 654 bp, Homo sapiens
agtaaccagacatctaaaagcagtgataacaggtaagctattaattaaattttagagcttaaggattttaacttacaagttttgagtttaggggattcttccctaaaaagttatgctagtaaccctcagtttacctacagattctcttttcattacagctttttctatgcctatacatactgtttactatggacattttttctaccctactacctcattctttatttctttatttatttattttttagagttgaggtcttgctcacttacccaggctggagtgcagtggcacaatcactgcagccttgaactcctgggctcaagtgatccttctgcctcagcctcccatgtagctaggactatagtgtggcaccatacctggataattaaaaaaaattctttttttagagagaaggtcttgctatgctgctcaggctggtctcgaactcctggcctcaagtgattctcccacctcggcctctcaaatctctgggattataggtgtgagccacagtatctggcagctaccttattcttctaaattctgcattaaatttcattgtgtgactttaccgtggtttaacagttctatgctttatgaacattttggatatttctggttcatttctatccagaaaagacaaatcctatgtt

SEQ ID NO: 443598 - DNA, 5207 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcatgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaataatggtgtgttgtcatttgtgctttttcagggtgtttttttggtttgatatcttgaaatatgattaaaacattggcttcctaaaggcagtttccaccagtttgccaaaggatcattgtgtcagcagcaaatcagctgaactttatttccaaaggcaaaatcctttctgattattttagtaacatagtacttttatgatgttgcaaataaatgaagggcccacagcccaagaatgaattaccactgtggttcaacttaggttatttttgtgagctgaaatgatcatatctcagttgaaaactggctaaaatttagggccttaaattaacaggtatacattttatttccctataaatttttgcttttacaatttctagccactgcacctggccctagcttttgatactgtcatttccctttgggcttgagactgttctagtcaatcctggtctcattgtttgcctgacaggtaccatgatttaa

SEQ ID NO: 443599 - DNA, 4868 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcatgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacatttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtggttctgctcattaatcaccacgagtgtggatctgaagaagagtttattacctctctttttttgagtatgtttaacttcagatacacacaacgtagcttctccttccctattagattcttagaagggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaagtgaccaatgtactaactgagaaaaaaaaaaaaatacaaaaag

SEQ ID NO: 443600 - DNA, 1977 bp, Homo sapiens
cctttcctcgacgcccagccgtccgggccggggtgaaaaactgcgtgacacgcagtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgttggtttggaacattttattatgcagccttgaaaggagtgaatgtcgttccttttctagaactcattgggttacctgacagtgtggtaagcatcctgaaaaactcccagagtggaaatgccctcacagcatatgccttgtttaagattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatcaaata

SEQ ID NO: 443601 - DNA, 1796 bp, Homo sapiens
gccgcgcgcggcatgcagaagcttcactgagcgggcactggaggtcgcgagcacgttgctagtgggcgcggctggcggggccgggggcggcagggggctagcgtccggctgagcccggcgggttcctgcacgcggacccacgctttgtcgggctgctctgctgagtgacaccgccgtggcatccgaggagctgtggtccagcctgcgcggcgggaagcggcggcggcggctccagcgtcctaagagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgttggtttggaacattttattatgcagccttgaaattgcaacacctgctcggtataccgtgactttgggaggaacatctgtcactgtgaagtatctgcgcagtcatggctacatgtccacgccgccacccgtcaaggagtatctgcaggacaggatggaagagacaaaggagcttatcacagagaaaatggaagaaacaaaagatagactcactgaaaagttacaagaaaccaaagaaaaagtttcctttaagaaaaaagtggaataaggtgccttatatagcagtatagaaaattcctgcactttaaccctttggaaactatgggcaaagatacatgtgtctgattatttttttggttagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacacactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaacctgaaattcattgttaaaatcaaata

SEQ ID NO: 443602 - DNA, 794 bp, Homo sapiens
cagacgccgtcgcaagcttgatactacgcctgatgaaaggaaggaggtgttaagggacaccttgccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443603 - DNA, 750 bp, Homo sapiens
  misc_feature (37)..(37): n is a, c, g, or t
aaagaacctccgcctatcgtgagtcgtactgaaactngcatggcattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443604 - DNA, 1024 bp, Homo sapiens
agcgggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcgtgagcggatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443605 - DNA, 430 bp, Homo sapiens
ttgtcagtccgggcggcgggtggggggcggcgggctggggtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443606 - DNA, 1592 bp, Homo sapiens
agcgggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcgtgagcggactctcgctctgtcgcccaggctggagtacagtggcgtgatctcggctcgctgcaacctctgcctcctgagttcgggcgattgtcatgcctcggcctccggagtagctggggttacaggcgtgcaccacaacacccggctgggttttgtatttttagttgagacggggttttgccgtgttggcagagctggtcccgaactcctggcctcaggtgatccgcctgcctcagcctcccaaagtgctgggattataggcgtgagccaagggctcaacctaacttggtcttaagtgtgatttctgctatgcacacttctggcttcaccagccatggagtttggccgggatggtctactcatccgtaggctgcatgtctccctgcgcagccttcaatagaatgaactaatgggaaaggtttcactgctctcgcaacctttggttacatccaggagcagatctcagtttggtacaactgtgtctaacacctctctgatagctttttagtgaaagaaagaggacctttgttaggcaacagtatccagctagaatttaatcacattgttctgttttcattatatacagcttttcaggtaccttctattcaaggcaagtgatgatagcttcttgtgcaagggaatgaaagaaagtttccttctttaacacacttatttaatttttaaaagtgaagcaattaaataaaaacatcaaaatgttgaggtgatatgtaaaatttaagagggcatgataaaatagtatggggataggtaaaaattaggaagatagtgcttaaataattggcatttgggcaacactttaaacattggaaagcgagaaagcactttatgggtcattggtctgctggctccacccctacctaccctatgtactagactgtttaggaaggctgaggccatgtgtcagtgagcttaccgttacatcctgggaactggtaggtgctcaataaagaaatgaaatgtaggtggatggatacatcatgtggctcagatcccttgttttgcaggtgagaaaactgaggtttaaaggaacaggtgacttggctgggagcactcagtcatttagtggcagtaggcaactgtggccccatctccagtactgagtcccgagcccctttcactagcacatgctgcctggtagagtatgaacagatagttaccaaatgctctacacagagaacatttaacccccagtcttaacaagtgccggtgattcatgagatattgacccatgtcctttattttacgagtgtgtctcttttaaactccaaaaatgtttttatgcttttatgagtgtcctgaactttacatgggtgctgctggagattaaatcctccatcagacccctccattcaatattttcagcagaattttatcactatgaattcaacatccccaccacaaaaaaaaaaaa

SEQ ID NO: 443607 - DNA, 309 bp, Homo sapiens
ctggtgacagagtgagactacatttcaaaaaaaaaaaaaaagtaatgaattaaaggaggctgtggtagcccagtcatgggggttgtgaaatggcatgacaaggtgcttccctcctgggggttgtccttggggttgatgggaaccaggcgggtggtattgtttctacacctgcctgttagtaatcccacaatgactatcacattggcccatctgcctgccacatacaccctttcactttgttcttaaagctgggatggaaattctatgatgctgatgattatcacccggaggaaaatcgaaggaagatgg

SEQ ID NO: 443608 - DNA, 1627 bp, Homo sapiens
agcgggcgcagaggggcacggccctcactgccccggccggggcgagagcggctccgcccctcgagcgccgggtaggccggggccggcggggcccggaaggcgacgggaaggagccgagcttgggttatggcggcgccgggcgcgctgctggtgatgggcgtgagcggactctcgctctgtcgcccaggctggagtacagtggcgtgatctcggctcgctgcaacctctgcctcctgagttcgggcgattgtcatgcctcggcctccggagtagctggggttacaggcgtgcaccacaacacccggctgggttttgtatttttagttgagacggggttttgccgtgttggcagagctggtcccgaactcctggcctcaggtgatccgcctgcctcagcctcccaaagtgctgggattataggcgtgagccaagggctcaacctaacttggtcttaagtgtgatttctgctatgcacacttctggcttcaccagccatggagtttggccgggatggtctactcatccgtaggctgcatgtctccctgcgcagccttcaatagaatgaactaatgggaaaggtttcactgctctcgcaacctttggttacatccaggagcagatctcagtttggtacaactgtgtctaacacctctctgatagctttttagtgaaagaaagaggacctttgttaggcaacagtatccagctagaatttaatcacattgttctgttttcattatatacagcttttcaggtaccttctattcaagatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443609 - DNA, 792 bp, Homo sapiens
cccctactctacctccaagattcccgccgtcgacccccccgtggccctttcgggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtc

SEQ ID NO: 443610 - DNA, 780 bp, Homo sapiens
  misc_feature (1)..(2): n is a, c, g, or t
  misc_feature (5)..(5): n is a, c, g, or t
  misc_feature (7)..(8): n is a, c, g, or t
  misc_feature (16)..(16): n is a, c, g, or t
nnggngnnatcaaacntataggctaggtacgaggctgggtgtgttgctcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccagcccccccgagggctttttcgcttttccgggttccgaagcccgttca

SEQ ID NO: 443611 - DNA, 1636 bp, Homo sapiens
cggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaacaaaagggcggccgactagttctagatcgc

SEQ ID NO: 443612 - DNA, 885 bp, Homo sapiens
cccattcgagctcggcaccccggctctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggctgagaataccgcgttgtatttatagatttttgtgttgtgtgtgattggaagt

SEQ ID NO: 443613 - DNA, 1477 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaacaaaagggcggccgactagttctagatcgc

SEQ ID NO: 443614 - DNA, 1957 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaaaaaaaaaaaaaaaaaaaaaaaaaaaaacaaaacaaaaaaaaaacaggggggcgcgcgccaaaagaaatattccccgcggggggcgccccacgaattgtaggcggcactaccccgcgcttttttttgtgaaaaaagggggggccccaataatggggggggcggatatattataataaaggggggggcgggggggcgggctgttttaaaaaaagggctagggacagggggaaaaagtggagtagccggggagcacctttgggggagagaggagcccccatatctgtcttgggggggggggggaccagtattgtgggacagcatatatccctccatgggagatttaaaagcggctagcaggggataaatatactaaaccttgagggtgtattatgtgggtgaacacacaacgagggaataatagcaggcgccgaaaagaatttgggctaaccgggagggtatattttgagatattttttacgagcgttgttttgaaataaagc

SEQ ID NO: 443615 - DNA, 1666 bp, Homo sapiens
  misc_feature (1517)..(1517): n is a, c, g, or t
  misc_feature (1519)..(1520): n is a, c, g, or t
  misc_feature (1522)..(1522): n is a, c, g, or t
  misc_feature (1525)..(1525): n is a, c, g, or t
  misc_feature (1528)..(1530): n is a, c, g, or t
  misc_feature (1532)..(1533): n is a, c, g, or t
  misc_feature (1536)..(1537): n is a, c, g, or t
  misc_feature (1539)..(1539): n is a, c, g, or t
  misc_feature (1542)..(1543): n is a, c, g, or t
  misc_feature (1551)..(1552): n is a, c, g, or t
  misc_feature (1579)..(1579): n is a, c, g, or t
  misc_feature (1662)..(1662): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaaaaaaaaaaaaaaaaaaaaaaaaaaaaacaaaacaaaaaaaaaacaacccaaaaaaaaaantnnantanaannnannaanntnaanntttttttnnaattttttttttttttaatttcttctnttttttttttttttttttttttttttttttttttttttttttttttttttttttttttttttttttttttttttttttttttntttt

SEQ ID NO: 443616 - DNA, 1706 bp, Homo sapiens
  misc_feature (1557)..(1557): n is a, c, g, or t
  misc_feature (1559)..(1560): n is a, c, g, or t
  misc_feature (1562)..(1562): n is a, c, g, or t
  misc_feature (1565)..(1565): n is a, c, g, or t
  misc_feature (1568)..(1570): n is a, c, g, or t
  misc_feature (1572)..(1573): n is a, c, g, or t
  misc_feature (1576)..(1577): n is a, c, g, or t
  misc_feature (1579)..(1579): n is a, c, g, or t
  misc_feature (1582)..(1583): n is a, c, g, or t
  misc_feature (1591)..(1592): n is a, c, g, or t
  misc_feature (1619)..(1619): n is a, c, g, or t
  misc_feature (1702)..(1702): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaacaaacaaaaacaaaacaaaaaaaaacaaaaacaaaaaaaaaaaaaaaaaaaaaaaaaaaaaaaaaaaaaaaaaaaaaaaaaaacaaaacaaaaaaaaaacaacccaaaaaaaaaantnnantanaannnannaanntnaanntttttttnnaattttttttttttttaatttcttctnttttttttttttttttttttttttttttttttttttttttttttttttttttttttttttttttttttttttttttttttttntttt

SEQ ID NO: 443617 - DNA, 1427 bp, Homo sapiens
  misc_feature (55)..(55): n is a, c, g, or t
ttaacagcagctatccaatccgataagcacatacacaactcatccacttaggacnagtacgaggctgggtgttgctgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443618 - DNA, 1198 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctaccatggtctggggcttgaggaagatgagtttgttgatttaaataaagaatttgtcatttttgaa

SEQ ID NO: 443619 - DNA, 1732 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctcccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaaaaaaaaaaaaaaaaaaaaaaaaaaaaacaaaacaaaaaaaaaacacaacgcgcgtgtgtgcgcgcgcgcgcgccgcgcgcgcgcccgccgagaagaaacttttcataacacaccccatcgtgggtgaggggcgcgggggcggcgcccccacagggtaggcggacaccgcgtgggccacaagcgggggtcccccagaggaaagacacgccgggcgccagcacgacgacgacggcgggggtgggattctctcaccaaccaataataaaaaaagcaggcgcgcgggggggggaaaaacacgcgagcgggttttcgcgacgaaacaacactccgaagagaggggaagctgcagagagaagggctacgcaacgaggggggtacttcacaatcacacgcgaggagaggcccgccaggagggaagagccgcggtaatacatctaaaatatagccccccggcgcggggcggagaacac

SEQ ID NO: 443620 - DNA, 1395 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggactctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443621 - DNA, 1078 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattcgtcctgcctgaatgggacctctagagcgccaccc

SEQ ID NO: 443622 - DNA, 986 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatgcacgagaaccacacgccagcacaagaa

SEQ ID NO: 443623 - DNA, 1401 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacgcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443624 - DNA, 1498 bp, Homo sapiens
  misc_feature (451)..(451): n is a, c, g, or t
  misc_feature (462)..(462): n is a, c, g, or t
  misc_feature (465)..(467): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacgctatgtgagctcattaatgcactgtaccccgagctccacagtttggaagatgtcagtggtgttaatgccatagcgctcagctgctgcaggaactgagagatctgctccatcgcttgaagnccatggtggangcnnngatcttctttactggggcctgcccctcggggtacagtgcattaatgagctcacatagcaccgtgccatccttgagccagttctggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443625 - DNA, 1213 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443626 - DNA, 808 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccagcccccccgagggctttttcgcttttccgggttccgaagcccgttca

SEQ ID NO: 443627 - DNA, 1073 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccatgcatccagaatggtaagtcctaactgtagaactacaaacaaccgaagggacacgtccatgaaaggcccagagatcacaagccagtactgaaaggtggggggtcagacgagcagcaccataggaggtacagcagaagcgcacccgaggaacaacgaacgagcatacccagagacgaaacacggaccgcggccacgcctacccgcggacacaaacgggccacaaccacgcagcacggcggcaaaccgagcaccaagaccacgcagcaaggcgcgcgaaccaaaccagcgaagagaacgaaccagaaccaagag

SEQ ID NO: 443628 - DNA, 838 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccatgtgcagtccacctccttgtgctgtccacctcctctgtgcggtccacctcctctgtctgtccacctcctctctgggg

SEQ ID NO: 443629 - DNA, 741 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaaggcctggggtgggatcagaggatctggcgtggcatcccgtagccagtcatgcctgcctgagacgccccgcggttggtg

SEQ ID NO: 443630 - DNA, 548 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaagaaagaacatggccccggtacattgcagggtacccgagctcga

SEQ ID NO: 443631 - DNA, 664 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgtgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443632 - DNA, 543 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgctaccatggtctggggcttgaggaagatgagtttgttgatttaaataaagaatttgtcatttttgaa

SEQ ID NO: 443633 - DNA, 368 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggccttgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443634 - DNA, 177 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacggtgagcaggtcgggggtacgggggtcggggacatgtgcgtgctgtgtagaaagc

SEQ ID NO: 443635 - DNA, 1400 bp, Homo sapiens
  misc_feature (1)..(2): n is a, c, g, or t
  misc_feature (5)..(5): n is a, c, g, or t
  misc_feature (7)..(8): n is a, c, g, or t
  misc_feature (16)..(16): n is a, c, g, or t
nnggngnnatcaaacntataggctaggtacgaggctgggtgtgttgcttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443636 - DNA, 1440 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443637 - DNA, 1695 bp, Homo sapiens
  misc_feature (1459)..(1465): n is a, c, g, or t
  misc_feature (1546)..(1546): n is a, c, g, or t
  misc_feature (1548)..(1549): n is a, c, g, or t
  misc_feature (1551)..(1551): n is a, c, g, or t
  misc_feature (1554)..(1554): n is a, c, g, or t
  misc_feature (1557)..(1559): n is a, c, g, or t
  misc_feature (1561)..(1562): n is a, c, g, or t
  misc_feature (1565)..(1566): n is a, c, g, or t
  misc_feature (1568)..(1568): n is a, c, g, or t
  misc_feature (1571)..(1572): n is a, c, g, or t
  misc_feature (1580)..(1581): n is a, c, g, or t
  misc_feature (1608)..(1608): n is a, c, g, or t
  misc_feature (1691)..(1691): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaaannnnnnnaaaaaaaaaaaaaaaaaaaaaaaaaaaaaaaaaaaaaaaaaaaaaaaacaaaacaaaaaaaaaacaacccaaaaaaaaaantnnantanaannnannaanntnaanntttttttnnaattttttttttttttaatttcttctnttttttttttttttttttttttttttttttttttttttttttttttttttttttttttttttttttttttttttttttttttntttt

SEQ ID NO: 443638 - DNA, 1927 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaaaaaaaaaaaaaaaaaaaaaaaaaaaaaaaaaaaaaaaaaaaaaacaaaacaaaaaaaaaacacaacgcgcgtgtgtgcgcgcgcgcgcgccgcgcgcgcgcccgccgagaagaaacttttcataacacaccccatcgtgggtgaggggcgcgggggcggcgcccccacagggtaggcggacaccgcgtgggccacaagcgggggtcccccagaggaaagacacgccgggcgccagcacgacgacgacggcgggggtgggattctctcaccaaccaataataaaaaaagcaggcgcgcgggggggggaaaaacacgcgagcgggttttcgcgacgaaacaacactccgaagagaggggaagctgcagagagaagggctacgcaacgaggggggtacttcacaatcacacgcgaggagaggcccgccaggagggaagagccgcggtaatacatctaaaatatagccccccggcgcggggcggagaacac

SEQ ID NO: 443639 - DNA, 1442 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggctgagaataccgcgttgtatttatagatttttgtgttgtgtgtgattggaagt

SEQ ID NO: 443640 - DNA, 1420 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaactgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443641 - DNA, 1395 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctcctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443642 - DNA, 1109 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctatctaccatggtctggggcttgaggaagatgagtttgttgatttaaataaagaatttgtcatttttgaa

SEQ ID NO: 443643 - DNA, 1233 bp, Homo sapiens
  misc_feature (993)..(993): n is a, c, g, or t
  misc_feature (1003)..(1003): n is a, c, g, or t
  misc_feature (1039)..(1039): n is a, c, g, or t
  misc_feature (1046)..(1046): n is a, c, g, or t
  misc_feature (1151)..(1151): n is a, c, g, or t
  misc_feature (1205)..(1205): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatctcccccctccccccctcccccccccccccccccnccgaccccantctcggccctcctcccccccccccctcccctgcccnattctgnctctccttcttccccccccccccttctcccccccccccccgtccccccccccccttccctccccccccccccctcctccccccccccccccccccctcccccccnccccccccccccccccccccgccccccccccccccctccccccccccccccccntcctcggcgccccccccccccccccccc

SEQ ID NO: 443644 - DNA, 993 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatctgggacacccctcgagcctggacacccctcgtgc

SEQ ID NO: 443645 - DNA, 1772 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagtaagtattgctgggacagccgcagggtccagcaggtgcattgtttctgcccaatcctgtccctaggaaataacttatctcagtagcagctggccctttacaaagcactttcagaaaattcctcatctcacttaatcctcacaacaccctctgggatggcaaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443646 - DNA, 1278 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaactttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaa

SEQ ID NO: 443647 - DNA, 1141 bp, Homo sapiens
  misc_feature (1141)..(1141): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaccagaatcacaaccgacagcacgcaccagacacacacaagcaaggaacacacacacgaaaaacaaccacacaagacaacacaacaaacccagacaaacacagcacaacagccagagaagaaacagacagacgaacaacagagagccaacgacaacagacacagaacacacacaacagaacaaaaatgaaagacacgacatcaacccgagaacaacaagcgggaactacagacagccgagagactgacacaaaacagacagacgaaagacaaagcaacaacaagagagagaagcaacaaaaacgacgcagacaacaacgaaggaacacaaaacgcagacgaaaaacagcacaccagaaaaaagagaagcagcatacaccan

SEQ ID NO: 443648 - DNA, 1033 bp, Homo sapiens
  misc_feature (1)..(2): n is a, c, g, or t
  misc_feature (5)..(5): n is a, c, g, or t
  misc_feature (7)..(8): n is a, c, g, or t
  misc_feature (16)..(16): n is a, c, g, or t
nnggngnnatcaaacntataggctaggtacgaggctgggtgtgttgcttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccatgcatccagaatggtaagtcctaactgtagaactacaaacaaccgaagggacacgtccatgaaaggcccagagatcacaagccagtactgaaaggtggggggtcagacgagcagcaccataggaggtacagcagaagcgcacccgaggaacaacgaacgagcatacccagagacgaaacacggaccgcggccacgcctacccgcggacacaaacgggccacaaccacgcagcacggcggcaaaccgagcaccaagaccacgcagcaaggcgcgcgaaccaaaccagcgaagagaacgaaccagaaccaagag

SEQ ID NO: 443649 - DNA, 660 bp, Homo sapiens
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaatccagagatcctcgggatcctctaggtcacctcgcatgcagcttcccc

SEQ ID NO: 443650 - DNA, 583 bp, Homo sapiens
  misc_feature (550)..(550): n is a, c, g, or t
ttagatcaggcatatgtactgaggcctcggtggttatgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaagaaagaacatggcctgtgtgcagcggcgttggatgcagtcagcgncgttggatagcagtcagcggcgttgatgcagtc

SEQ ID NO: 443651 - DNA, 351 bp, Homo sapiens
gggaattaggtgatcctgtagatccttccaactttatgatttttagagattttatttttgcccaagtcatcagtaagtatgaggacattttttttgtgtttttccaagtgggttgtttaaaattttttcctttttttattcctcttcccaaggcaaatgaaaaaaaagttgaccagcctccagaagctaaaaagcccattagggaaagaccttcttaacatgtatattgagacagaggtaagtacttcaattaaatatttttattttgaaatatgtttagtttcttggccctgatatctatatttctagtagataaatggccataattctttctcatcccaagttttatat

SEQ ID NO: 443652 - DNA, 255 bp, Homo sapiens
gcagggaaaaaaaggaatgaaacagtgataaaattctagtgtgtttgttcagagctttagtgatagttttcactgtctttgagtttatcttgcagattttgaaatctttaaagtctgtcgtcacactattttgcctcttgttccctcttgctgcttactttctggcattttctataggagaaggaaaaagtataaataaaatctgttcatagatgggaaattcagtgaaattggtgggcctcagggcaacttatg

SEQ ID NO: 443653 - DNA, 198 bp, Homo sapiens
gaaactctgtctcaaagaaaaaaaaaaatgtatctgcccttgactagttttcaactaatggcatagatcattctataaacagataatgttagagatacgtatctctaacattgaccttccactgaatatcgaatgctttatgaatgataaagatgtttccggaaagatgaacaggtgtgtcttgaattctacagatta

SEQ ID NO: 443654 - DNA, 5270 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443655 - DNA, 4024 bp, Homo sapiens
  misc_feature (3693)..(3693): n is a, c, g, or t
  misc_feature (4024)..(4024): n is a, c, g, or t
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaaaaaaaaaaaaaaaaaaaaaaaaaanaaaaaaaaaataaatattaaaaaaataaaaaaaataaaaaaaaaccttgtgggccgctttggccaattcgattttaaactcgaccaggcttatccttgcggcccaaattggggttaattgggccaattccccctatagggaggcgattaaccattacaagggccgtcgtttaacaccgtctgaattgaaaaacacctggggtaccccacttaaatcgcttggaacaaatccccttttcccagttgcctaattacaaaaacccccacccgatggcttttcaaacattggccacccttaatggcaaatggaatgggccttttttggtccgccn

SEQ ID NO: 443656 - DNA, 5310 bp, Homo sapiens
  misc_feature (292)..(292): n is a, c, g, or t
  misc_feature (297)..(297): n is a, c, g, or t
  misc_feature (316)..(316): n is a, c, g, or t
  misc_feature (334)..(334): n is a, c, g, or t
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgatcgatccttcctggagctggtcaacgcacgcgaacaancgtgnctcaagaagcccccgcggnccgggcggcctccgtgancccccaggaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443657 - DNA, 5143 bp, Homo sapiens
aacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443658 - DNA, 5217 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccattagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443659 - DNA, 4246 bp, Homo sapiens
tctgtgtcagggggaaaaattttagaaggtaaaatggcagtcataagcatgtaaaatgatttgtttgagtaataccaggagaactgtcttccgcatcatctttctgcacctgtttggtgtatttatcaaaaacaaaagagctataaactacaatacagctaaacttggcccatgtgggatccaaggtgtctgagggggaaaataatgaaattcattgggttgtcaaaagtaggacaggatattggtcttaacttttctaaaaacaagtttttatttgctaaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443660 - DNA, 5216 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagtgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443661 - DNA, 3533 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatgattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctagtgggatctatttctggctccctcaggggggggcccgggcccccaaattcgccctattgttgagtcgttttttccgcccccctattgggctgtcgtttttaaaaaccttctggactg

SEQ ID NO: 443662 - DNA, 3108 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggtgagtgttactgtctcgtgtttactgctgggttcacttacggactcaagttgcaatcatttgaaccttcaacatagccatttttcctgtaaatcttttacctcatcctaactgaaaccagcttttcttagtctattattctgtcacaaaatacagaagacctcataagtttgttgaatttccacttctccatttattcattcatttcaacaagtgtatttgttgagcacctgtcatgtaccagtccttgttctcaggattaaacaagtgtgcaaagtgtagtctctgcccttatggaactcatcttgtaatgggagggagaccaacagtaaacaagcct

SEQ ID NO: 443663 - DNA, 2723 bp, Homo sapiens
caccaggtttttcgtacttggcgatattaatgagaatcttgaagttgggatgctgccaaaaattgcttggtaagttgctggtgctggaattgtgaattcatactaagctttctgtgcagtctcaccatttgcatcactgaggatgaaactgacttttgtcttttggagaaaaaaaactgtactgcttgttcaagagggctgtgattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443664 - DNA, 2562 bp, Homo sapiens
cgcggccgcgcgaccggctgcgagagacgacagagggtgctcaggaaaaaacaaaatcaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443665 - DNA, 2254 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgtaagtttgtggataaacctttgtgtttgaatagagttgacttagttctaagctataggagaattgggtagggaagggttaaaatgaatgttttccttcatgaataattttgatcagaattttaggtaatgataatagcgcttgccggttagtggtaatacacagcttgaaatttggtgaattgtgactaaattctgtgtaacttaatttgaagtaactagtatatgacagagtagatgatgttttatcttgttgggagcttttttggtttt

SEQ ID NO: 443666 - DNA, 2414 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaatagcaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcattgtccggcagggagtcccgccttggccccaacgatgggtgtgggggtttcacaaaaagccgacccaagggttaaccatggccagaaaagtcggaaaacaaaagggcacaagtacagcaaccatccccgcc

SEQ ID NO: 443667 - DNA, 1315 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacattcactgctcgatcgctctatcgaccgatcaagcatgtttctccgcaacggctgaacaggcctctcttgct

SEQ ID NO: 443668 - DNA, 735 bp, Homo sapiens
aagcatatgttgacaagttggaagaattaatggtaggtcgttttctcccccaaaaggtggtacttgtgttttaaactatagactttaaaataaaattatgataactattaatttattacattttattttagaaaattggcactccagttaaagttcggtttcaggaagctgaagaacggccaaaaatgtttgaagaactaggacagaggctgcagcattatgccaagatagcagctgacttcagaaataaggtgagtcagtctttttgtacatagggaggaagttaacctagattttaataagctaacacttaagctgggaatcatcatgaatagtcttaactttgaaattttggtatttgaggttagaggtagatttgaacttgagcttcctggaaagttgagtcaaatgagatactattgttcaataaattctacagaatgaccgtgttatttttgttcaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggtgagtgttactgtctcgtgtttactgctgggttcacttacggactcaagttgcaatcatttgaaccttcaacatagccatttttcctgtaaatcttttacctcatccta

SEQ ID NO: 443669 - DNA, 593 bp, Homo sapiens
gggtataaaacctcacaagtttagcagggaaaaaaaggaatgaaacagtgataaaattctagtgtgtttgttcagagctttagtgatagttttcactgtctttgagtttatcttgcagattttgaaatctttaaagtctgtcgtcacactattttgcctcttgttccctcttgctgcttactttctggcattttctataggagaaggaaaaagtataaataaaatctgttcatagatgggaaattcagtgaaattggtgggcctcagggcaacttatgtgcactcataggattggtttgagttgtaaagtgaataaataaaattactaaaattactggtaggtggtgaaattaaagaaaaaaattaaaatctcaaacttctttttgcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatataattgagcaaccttagaaaaataccaacttattaatacttaaaaatacgaacttat

SEQ ID NO: 443670 - DNA, 424 bp, Homo sapiens
actataactcgagagcgccgattaagccggagcgagaggatatgcattagcagatgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaatagtaggtaaggagttcattgtgtatattttactcttttagttaaagacttagcttctcactcattgtacaaactttaaaagttgtcttattcttagtaatgttgaggggaacataattctgtgtgaagaca

SEQ ID NO: 443671 - DNA, 5138 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443672 - DNA, 5147 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443673 - DNA, 5227 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443674 - DNA, 5020 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatgattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443675 - DNA, 5136 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggcttttatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443676 - DNA, 2967 bp, Homo sapiens
gagaatacctctttgttttgttgtgaaaaattctgaagtacgagtgccactaatattgtcatattttgtgttaaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattctttttttttttttggtagagctggggtttcgctatgttgcccaagttcgtcttgaactcctgggctcaagcaatctgtctgcctcagcctcccaaagtgctgggattacatggtgtgagccaccatgcccagccatttatgatcttgatgagggccaactttccctcttccacaagggattaatcttagaactatagccaatttattataagtactatttagctactctgtgctccacacatcacggagtaatatcttcaaactatgaggtttagtaacacttgactgctgaggtttatttcctcagctctgatgcttcctgggtgaagatgtaagttattaaattaactcaaattttaaagctaacacttcattccatctagaccaggtagctcgtcatttgtacgtctgataggtgcttcaacatctcagaattggcttatttttcatgcattgcatattgtactcatttgtaatattggaatgtaaaatgttcttactaagaatctttatgtcagctattcaacatttccctactttataatttctagctgctttaccatttagcaactttaaatttttatgcagttaatatgtttctttggtttttatgttttctgaatgtctttaatgcacattaatgtatacttagtagatacacatttacacattgagaagtgaagataggtttgtgttctgtgtacaattaggacatccattaaaaaagatttttaaaaactgtgaatgggaaaacatgtttttcctcctgtcctaaaatagaacctgatgacgggagggagcatcagtcagtctggcctaaatcagtgtactgcgcttttggatgcgggcaaaagtattgtcatgttgattactttataataacgtattaatatcattggctcaaacagttgtgatatatacctagtaatcatcgaggatctcaaagatatgcaccagtttgaataaatgctgtttaaagattaaattttacaattcatttta

SEQ ID NO: 443677 - DNA, 2487 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagttagatgataatgaagattaatgacagaaggatgagctaaaatgcgtggggaatgtgttgagtcgaaacaggggttggccttgaaattttggggcggggtcaattttgagaaccctagaagaacggggttaaggagggcacataagctttttaggggaatggactgctaagtgggtgaagaaagcgattgaaaacgggttcaaggaaaagaaaatggtagagcggagacgcgaat

SEQ ID NO: 443678 - DNA, 2390 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaatagcaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctcaatccgttgtgtggtgctgttttccccaaaatgcctccaagggcgtccctttgcgcccttcgtcgttccc

SEQ ID NO: 443679 - DNA, 1684 bp, Homo sapiens
ccgcggcagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443680 - DNA, 1826 bp, Homo sapiens
ccgcggcagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatgttctgatttctgttgacattcttttggctagtagaagacaaaagtaatacatttatggtatgcaaagcactatcctaggtatttcattgtaatattttacttaccccttatcacaactctgatagattct

SEQ ID NO: 443681 - DNA, 504 bp, Homo sapiens
ctaattaaaaaaatttttttgtttaaattatgggggttaggccggccctggggcaagttttaaagttgcggaaattctggggaaagccttgaaaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatgttctgatttctgttgacattcttttggctagtagaagacaaaagtaatacatttatggtatgcaaagcactatcctaggtatttcattgtaatattttacttaccccttatcacaactctgatagattct

SEQ ID NO: 443682 - DNA, 1630 bp, Homo sapiens
ccgcggcagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443683 - DNA, 686 bp, Homo sapiens
gttgtctgaattgttagtgaaggtctgtgtctgcttggtaggaatggtggtattacgcttgatgctgggcgactggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443684 - DNA, 1932 bp, Homo sapiens
ggaattcggcacgaggagagagagaactagtctcgcgttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443685 - DNA, 1555 bp, Homo sapiens
ccgcggcagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443686 - DNA, 1575 bp, Homo sapiens
acatgcactgcatcctcagtcgacctatataatcccaatcataatctatatccaacttgtcctcacttactctcgattttgatgtccacacacactgcctatatagaataattagttaccccaactaccagaattatataatcatttttatactcaagatcatattgagctcctcatcattacgacctgaaagtcttcaacctcttcaactgacacttctctctccatttcttgtctctgggaaccctctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 443687 - DNA, 1150 bp, Homo sapiens
ttccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagatgattagtgagcaggggactgatttcctcgttcctcattcatgaacaacaactaacatttgtgtagcagcatcttgaggtattgggcattgccacttacattaacccgttggattcacgtttcatgggtttaaaaagcgaggtttgagggctggtgggccttttccagggcacccacaaataaaatccagcgttttctttggaggaggccaagctgagattggaggcagcttcctagagcccttctcatcactcgcacagcaccgccaccgccaacttgttccttgagtccggggtttgaggaacatccatgtgaagagttccctgaggtctcctgaccaggctgctttatctgtggcccttcagactatggtcctgtgatccgccagcctgccatgggctgcggagagttaggtagccaaggcctgaacgctgtgcccttcttgaagtacataccttgaaacctcaccccgagatgatggtattaggaggtggggccttgggaggtgattaggtccccagggctacaccctcataaataagattagtgcccttataaaagaggctgagggtgtctgtctgccttcgtgaggacacagcagccaggcaccatctttgaagcagagagcagccctcaccggacactgccatctgctggggccctccacgtggacttcccagcctccagaactgtgagcagtagactcctgttgtttgtaaattacccagtctaatcttttggtgtagcagccccaaaatgaccacagcatatgccattgctaaacttccacaatgcttttttctcgatgtgcagggaaaaagacacaatctgcagacctttctcaattaaacttttctttccctggcattcatattt

SEQ ID NO: 443688 - DNA, 3429 bp, Homo sapiens
ttccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaaatcgcgggcagaacctctcatctgtgcacaagggacccagcacggggctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccatcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 443689 - DNA, 3664 bp, Homo sapiens
ttccctttcggccgtgggggagggggctcgtgtcccccccaacccagcccggaggccgcgtccgcccgcgcccgctctggcccccgcggagccgcgcaacttcccgggagcccgggccaaagtgagcgcaaagtgctgcccaagttgccgggatggagctgcagagccggcccgaggcgctcgccgtggaactcgcgcgccaccagaacggcgacctcaagaagcagctccacgaaaggcagccgcggatcgccgcgctcagcgacaaacaagctttgggaacgatcactgcagtgcctgtcacgggtcctcaggtcagctccttgcagaggttggccgggcaaggagcggcagtgctacctcaggttaggccaaagactctgattccagacagcctccccgttgccccgggccgggaccggccacccaagcagcccccaacattccagaaggccaccgtggtcagcgtcaagaaccccagcccagccctccccaccgccaacaacactgtcagccatgtgccagcgcccggcagccagccccaggccctcgccgagcccgccgccctcgcctctccgctgagcagtgcgggggtggcctacgccatcatctccacctcccccagcaatgccgccgccatggcccccagcaccgccgtgtctgtggtcagtgacagcatcaaagtccagcccctcctcatcagtgctgacaacaagcctcctccacgcctcctctcttcccctcaccccgcaacccatcactgtcccctccacccctcctctcttcccctcacccctccctccccatcactgtccccttcacccctccatggcatcttccaggtcatcatcattcagcctcaagtgcagacgcagcccgagagcacggcagagtcgcggccgcccacagaggagccatctcagggagctcaggccaccaaaaagaagaaggaagaccggcccccgacccaggagaaccccgagaaaatcgccttcatggtagcgctaggcctggttaccacggaacatttggaagaaatccagagcaagcgacaggagcggaagagaagaagcacagccaaccctgcctacagcggcctcctggagaccgagaggaaacggctggcctccaactatctcaacaaccccctgttcctcacagcgagagccaatgaggacccctgctggaagaacgagatcacccacgatgagcactgtgccgcctgcaagcgaggggccaacctgcagccctgcggcacctgcccgggggcctaccacctcagctgcctggagccgcccctcaagacggcgcccaagggcgtgtgggtgtgccccaggtgccagcagaaggccttaaagaaagacgagggtgtgccctggactgggatgctggccatcgtgcactcttatgtcacccatcaaagaagaggagaagcagaagctgctgcaacgaggcagtgagctgcagaacgagcaccagcagctggaggagcgggaccggcggctggcgtcagcagtgcagaaatgcctggagttgaagacaagcctgctggcccgccagaggggcacccagtcatccctggaccgcctgcgggccctcctgagactgatacagggcgagcagctgctccaggtcaccatgacgaccactagccctgccccactgctggccgggccctggaccaagccctcagtggcagccacacaccccaccgtccagcacccccagggccacaactgaccccgagggaccagtcttcatacccacggaaagttattgggaccctgcttacacagcctgggggttctgtcggccttaattcataaacactatgaatttcagacaaaaattaaccagacagaggagaggagggaggaagagctgggcgagaggcctagagccaggaccaggtgggggtgcggccctgtgccctccaaattcacagggggtacctaggagccaggtggggtacgacaggctggggcacacagtctccccccggccacctcggggctgcctgggcctctggcttccaggccctgctctccacggcctccctctggcccgttggaggggcaggctgaggctgtggaggggacaagcacgccccccagaacgcagtctccactgagggcaccgcctattggtgtcctgtgggagggcgagctgagaacacatggactagctgagtggtagcggtagttgggacgagaagcggggtagtggatctaggtagttcctcaatgccccacgctcctaggaggtccccctggggtgggcgggcgggcctggggcactccgtcgcctttgcagaaccacctgggcccctttctgtcagtattattagggttacgaattgcagctgtttaacttgaaagacactgtcggaggtgagcatctgggcgccgggacgctgcagtgatccccgccagagcctgtgcccttcctgctccgtctttggggtcctcaaggctgcctccttccttttgccaatctcttggactcagtttgccgttgatgcgtttttctcatggagtttctgggcagagtggagctgcaaccctgttgtggggggcagcatttggcaggttttctccttggggttgaatcattcaacttaacgactgaagccctttcttgtctcctttggaagagccgataagtattccactcctcccttcttgccagtgcagacactatgccaaaaaataacttcacacttttgtatggcgtttttattgtgagatatttaatgtgaatggttggggggactctggctgacttcctttctgcttctagtagtctctgcttcaaggtacaaatgggaacacctcccctcgggaagcctggccaagctggaagatccggcaggttttttacgagccgggtggagggttggggaggaaagaaagggcggtggctcgggaggttccggccttcggggaccagacttgctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaa

SEQ ID NO: 443690 - DNA, 2547 bp, Homo sapiens
agcggagggagagaactctggaggaacgctgagctgagcagcaccgaggacagcgcccggcagcgcccgcgcccaggtctccctccgcagccctgactcgcgcacacgctgagcttttgctcactccccttcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataacttaaaaaaaaaaat

SEQ ID NO: 443691 - DNA, 1767 bp, Homo sapiens
agcggagggagagaactctggaggaacgctgagctgagcagcaccgaggacagcgcccggcagcgcccgcgcccaggtctccctccgcagccctgactcgcgcacacgctgagcttttgctcactccccttcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgc

SEQ ID NO: 443692 - DNA, 380 bp, Homo sapiens
agcggagggagagaactctggaggaacgctgagctgagcagcaccgaggacagcgcccggcagcgcccgcgcccaggtctccctccgcagccctgactcgcgcacacgctgagcttttgctcactccccttcgcgcggacacagacacacgcatattcacacacccagacacacaccccgctgtacaatggcagaatcccacctgcagtcatccctcatcacagcctcacagtttttcgagatctggctccatttcgacgctgacggtgattatcttctctttttaactgtttcaagacccgtttccatgccccttcccattctttgcccttttctgagcctcctgatcccattatccctcctttctattctttacttct

SEQ ID NO: 443693 - DNA, 2451 bp, Homo sapiens
tctcttcacacggacgcacatgaaatttggtgccgtgactcagatcagggacctcccttgggagataaatcccctgtcctcctgctctttgctctgtgagaaagatccacctacgacctcaggtcctcagaccgaccagcccaagaaacatctcaccaatttcaaatctggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataacttaaaaaaaaaaat

SEQ ID NO: 443694 - DNA, 2047 bp, Homo sapiens
ttttcctccccaccccactaacaatcgttttttcctcccccacaacaaaaacaccttataactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataacttaaaaaaaaaaat

SEQ ID NO: 443695 - DNA, 2574 bp, Homo sapiens
tttccaggaacggtaatggtaggagagagagagcagggattggggaatgctgcccccccaaagtttctgtggctgcgcttagcaccccaaccatcctcctttgtcctcagtggatctaaagtttgataccccaggaggggagcgcttcaccgtctgtacactttgctggttaatcaacgtccaggcaagagagagcctctcgggtcgccagaaagataactgtcttggaaagtgaacgggaaagacacttggaatgagatatctgacacctgggtgcctctttgtctttgcaggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataacttaaaaaaaaaaat

SEQ ID NO: 443696 - DNA, 2524 bp, Homo sapiens
gagtctctggtgcagctggggtggaatctggccaggccctgcttaggcccccatcctggggtcaggaaatttggaggataaggcccttcagccccaaggtcagcagggacgagcgggcagactggcgggtgtacaggagggctgggttgacctgtccttggtcactgaggccattggatcttcctccagtggctgccaggatttctggtggaagagacaggaaggcctcccccccttggtcgggtcagcctgggggctgagggcctggctgtcagccactcttcccagaacatatgtcatggcctcagtggctcatggggaagcaggggtgggcgagcttaggctagagcaagtcctgtgggagatggcagaggcctggtctgagaggcaactcggatgtgccctccagtggccatgctcccctccatgcgtctcccctgccctcctggagccctgcaggtcaatgtttaacagaaaccagagcagcggtggattaatgcgcaagggctcagccccccagccctgagcagtgggggaatcggagactttgcaacctgttctcagctctgcctcccctggccaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttaaatacataagactgtttac

SEQ ID NO: 443697 - DNA, 2039 bp, Homo sapiens
gagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaaggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttaaatacataagactgtttac

SEQ ID NO: 443698 - DNA, 1949 bp, Homo sapiens
gagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggaatcatgtcaggccatcaaggagtatatggacactacactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttaaatacataagactgtttac

SEQ ID NO: 443699 - DNA, 2001 bp, Homo sapiens
gagtctctggtgcagctggggtggaatctggccaggccctgcttaggcccccatcctggggtcaggaaatttggaggataaggcccttcagccccaaggttgtcctcgaccagtcccgtgccatggcagcccacctgcttcccatctgcgccctcttcctgaccttactcgatatggcccaaggctttaggggccccttgctacccaaccggcccttcaccaccgtctggaatgcaaacacccagtggtgcctggagaggcacggtgtggacgtggatgtcagtgtcttcgatgtggtagccaacccagggcagaccttccgcggccctgacatgacaattttctatagctcccagctgggcacctacccctactacacgcccactggggagcctgtgtttggtggtctgccccagaatgccagcctgattgcccacctggcccgcacattccaggacatcctggctgccatacctgctcctgacttctcagggctggcagtcatcgactgggaggcatggcgcccacgctgggccttcaactgggacaccaaggacatttaccggcagcgctcacgggcactggtacaggcacagcaccctgattggccagctcctcaggtggaggcagtagcccaggaccagttccagggagctgcacgggcctggatggcaggcaccctccagctggggcgggcactgcgtcctcgcggcctctggggcttctatggcttccctgactgctacaactatgactttctaagccccaactacaccggccagtgcccatcaggcatccgtgcccaaaatgaccagctagggtggctgtggggccagagccgtgccctctatcccagcatctacatgcccgcagtgctggagggcacagggaagtcacagatgtatgtgcaacaccgtgtggccgaggcattccgtgtggctgtggctgctggtgaccccaatctgccggtgctgccctatgtccagatcttctatgacacgacaaaccactttctgcccctggatgagctggagcacagcctgggggagagtgcggcccagggggcagctggagtggtgctctgggtgagctgggaaaatacaagaaccaagactggggcccttcatcctgaacgtgaccagtggggcccttctctgcagtcaagccctgtgctccggccatggccgctgtgtccgccgcaccagccaccccaaagccctcctcctccttaaccctgccagtttctccatccagctcacgcctggtggtgggcccctgagcctgcggggtgccctctcacttgaagatcaggcacagatggctgtggagttcaaatgtcgatgctaccctggctggcaggcaccgtggtgtgagcggaagagcatgtggtgattggccacacactgagttgcacatattgagaacctaatgcactctgggtctggccagggcttcctcaaatacatgcacagtcatacaagtcatggtcacagtaaagagtacactcagccactgtcacaggcatattccctgcacacacatgcatacttacagactggaatagtggcataaggagttagaaccacagcagacaccattcattccatgtccatatgcatctacttggcaaggtcatagacaattcctccagagacactgagccagtctttgaactgcagcaatcacaaaggctgacattcactgagtgcctactctttgccaatccccgtgctaagcgttttatgtggacttattcattcctcacaatgaggctatgaggaaactgagtcactcacattgagagtaagcacgttgcccaaggttgcacagcaagaaaagggagaagttgagattcaaacccaggctgtctagctccgggggtacagcccttgcactcctactgagtttgtggtaaccagccctgcacgacccctgaatctgctgagaggcaccagtccagcaaataaagcagtcatgatttaaatacataagactgtttac

SEQ ID NO: 443700 - DNA, 655 bp, Homo sapiens
gctgtagtttgtagtcttgcttgaaacaatagaaacagactgattaagcaggagaagttttttgaaagaattttgtttggctcacggaattattagaaggcaggtgaaccaggagggtaagcttccagcagcaatttgtaaaaccatgccttagaattggactaaggaagaagctgctgacactccactgccacacagggcactggaagaaagtgctgctgcctccctgccccacctttgccacttctgcagcaggaataggtagaagaatgcccccacccgcaccggaacagcaacaaaaggattctgcatgagatgcctccctaaattgctgaattcaaaaaagaagttgcatacaaagacatctgattgaaaaagggtatgttatatgcccctttcataggctgctagggagttttcctggttctactttcaggtggtgggatcaataagaccagaatttctcatatgttgtgagaggattcaaatgttacagggttgccagccaaactatcaatcatgtataaatccaacaaacactttgtaacatacaagaactcaggaaatgtgaaccattgttggagaatctactaaaatacggcttcccgcaaacgaagatgaatggaaaatgtaaataaaaagaactggcagtgta

SEQ ID NO: 443701 - DNA, 1046 bp, Homo sapiens
gctgtagtttgtagtcttgcttgaaacaatagaaacagactgattaagcaggagaagttttttgaaagaattttgtttggctcacggaattattagaaggcaggtgaaccaggagggtaagcttccagcagcaatttgtaaaaccatgccttagaattggactaaggaagaagctgctgacactccactgccacacagggcactggaagaaagtgctgctgcctccctgccccacctttgccacttctgcagcaggaataggtagaagaatgcccccacccgcaccggaacagcaacaaaaggattctgcatgagatgcctccctaaattgctgaattcaaaaaagaagttgcatacaaagacatctgattgaaaaagggtatgttatatgcccctttcataggctgctagggagttttcctggttctactttcaggtggtgggatcaataagaccagaatttctcatatgttgtgagaggattcaaatgttacagggttgccagccaaactatcaatcatgtataaatccaacaaacactttgtaacatacaagaactcaggaaatgtgaaccattgttggagaatctactaaaatacggcttcccgcaaacgaagatgaatggaaaatgtaaataaaaagaactggcagtgtatatcagatgtttaactataggaccagaactaagatgtggagactattgccatagaccacaatgtaaatttttaagtgaggaaggaaaaatcaggaatcaaaaggggccaggtgcagtggctcacatctataatcccagagctttgggagttcgaggcaggaggatcacttgaagccagttttgagaccagcctatgcaacacattgagaccctatctctacaaaaaatagattagctgggcacggtggtgcatgcctattgtcctacctactgtggaggctgaagtaggaaatcacttgagcccgagagtttgaggttacagtgagctatgattataccactgcactccagcctgggcaagagagcaagaccttgtctcttaaagaaaaaa

SEQ ID NO: 443702 - DNA, 253 bp, Homo sapiens
ggaggaaggggcggagagggacctctgctttccaggctgccttttatactgcctctggtcacctgacatggaacgtaccctaacctaatcagttacctgtaccttaattgcaattaacttaatccaattacatgacctggaaaggtctatctgcacagcccactctaagatcctgtccactgctgacagacattctaaaacctacttgtacagctgcaagctttgaacaatagatgttccccgtcagacatgt

SEQ ID NO: 443703 - DNA, 152 bp, Homo sapiens
ggaggaaggggcggagagggacctctgctttccaggctgccttttatactgcctctggtcacctgacatggaacgaggcgcttggaaaccaccgtgaattggaccgcactgggaaacacagatgaggaaagtcaacaacgctttgtccttca

SEQ ID NO: 443704 - DNA, 915 bp, Homo sapiens
ttttctaaatacacatcaaatcatgttacttccctacctaaactacccagtagctactgtgtacttagaataaaacccagcgttcttaactggggcccatagggtaatatgtgatctgcccccatctgtctacctgatttcctactcttcctctcttcttaagccccagcatactgggcttatcattatgagcacttaccactctctaatggcatatttattggtttactctttgtattgtcttgtttctttgcttgaattatagacacatttgcatagcatttttgtcttgttcatcactttatcttcagtgcctagggaaatgcttggcacacaattaaaaaggtgttcaacatttatctattgatgaatgggtaaatccagcactgtctccctcttccctgccacctccatatcccagtagtcactaggacctgtaggttcatgtatgtctctttactctttttgatttatcctgaatgtcatgtctcattttatattctgtattatttgttttctggtctgttactgccatcttttaactggttttccttcagtgttttgtctattccagtctgtattttgcactgtcaccaaaagatgatttatgaagcataggtctttaaaaattacatgatgggctcggtgcggtggctcacgcctgtaatcccagcactttgggaggccgaggcgggcggatcacctgaggtcaggaattcaagaccagcctggccaacgtggtgaaaccccgtctctactaaaaatataaaaattagccaggtgtggcggtgtatgcctgtaatcccagctactcgaaaggctaaggcgggagaatggcgtgaacccgggaggtggagcttgcagtgagccaagatcgtgtcactgcactccaacctgggtgacagagtgagactc

SEQ ID NO: 443705 - DNA, 199 bp, Homo sapiens
actttattgcttcagatatgctcatccttctgtgttttccaaatataagctgatttggagagctgccttacctggtagtcttactggcttattctatacattcgtattctagttttactaagttacctctcctatcttttgtacatattttgtcctcactctcatcaacactctcctgtgtgccagttgtctttttttt

SEQ ID NO: 443706 - DNA, 2487 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagaaacacatggcgtaatgggaaaactggacagttacacaaggcagaaggagagtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 443707 - DNA, 414 bp, Homo sapiens
  misc_feature (8)..(8): n is a, c, g, or t
gcacgagntcgtgccgagacagtgcaaaggctgtgacactccatgcatggaaggacatgaggtctccccctgtccttcctggtggcctcccagacagtgcaaaggctgtgacactccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaaatatgctgtaacagatcaacaaa

SEQ ID NO: 443708 - DNA, 2123 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 443709 - DNA, 1636 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagcttcctccgtgttgcaccctgtccgaattcccttccgctgcaggctgtgacactccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaaatatgctgtaacagatcaacaaa

SEQ ID NO: 443710 - DNA, 1593 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggctgtgacactccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaaatatgctgtaacagatcaacaaa

SEQ ID NO: 443711 - DNA, 497 bp, Homo sapiens
aaaatacaaaaattaaccaggcatggtggtgggcgcctgtagtcccagctactcgagaggctgaggcaggagaatcgcttgaacctgggaggtggaggttgcagtcagccagcatagcaccactgctctccagccggggcaaaagagtgagaccctgtcttgaaaagaaaagaaaagaatcagaatacatgttaagaattagagaaaatgttattttgtgaagcatttccattttgtgtggcatgtatgtgttcattgtactgggttgcaagtaagatatgtttcttgctgtaggccacagtaagtctaaacatttgcaaaaccctgtagtagttaggtcagattgtcctgcacctctaatgagggcatgcatgtgctcaacaagcataaacatttgcggaacatctattatgtaccggagttctgccagtgctgtctaagatataatttcctgcctttcagaaacacatggcgtaatgggaaaactggacagttac

SEQ ID NO: 443712 - DNA, 2436 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 443713 - DNA, 2361 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 443714 - DNA, 2382 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaagtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 443715 - DNA, 914 bp, Homo sapiens
gcttccaagactctgaaataccaggatttccacaaactcatcttgccctgactgggaatctttcggagattggatttcagagtattccccaacctgatcggatatcacctcctcaatggaagcttccctaataccctctgatgtttctagaagcaggacacatggcttgtgtcataagtcttgacctgattatcatagattgcctcaccaagtttagcataccctgtctgagagtgatgctggcaaattagtgaataagaggactgtggaatttatttgattgctaatcttgtgtcaggacatggttattttttaaaaaagaagtgtcctcttttgatcttaactgtttgatatctcagcccttgagtgaggcagttatatgcaaaggagatgagaaggatgagaaaagtgagtacttttccttcataaaagccacatgaattgaacaagacttcagaattcagaagaactacatcaagttcttgggtcatttttttaacccattctccaagaattgaaaaaatgaccttgcaaatatgtgcaagactctggaatcttcctttggcagatgatgaatgagatgaatatttccaggtgcttgccttcagcaccagcacatgtacattctagtactcttggccttgatcctacactgaatctgagggtgcaaggactttagatagaggctcaggacagactggacctgtatgaacctctgaattgtagctagcctgggcagccagttacttggatccctctggggcttctggacaaacaactcttttatagcccaaggtagatggtcaggggcgaccagagagagcaatagattcgttgacttcaagcttaacatgagttagcagtatggtgaggcttccagcaaaatgtaagcactcaataaatgttagctatta

SEQ ID NO: 443716 - DNA, 956 bp, Homo sapiens
acaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttggtagagatggggttttgccatgttggccaggctggtctcaaactgctgacttcaggtgatccacccgcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443717 - DNA, 461 bp, Homo sapiens
acaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttggtagagatggggttttgccatgttggccaggctggtctcaaactgctgacttcaggtgatccacccgcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttctta

SEQ ID NO: 443718 - DNA, 907 bp, Homo sapiens
ggaatgggtcctgggctcatagacaaaaagagagatgtcacatggagatctgagggctcaaagttttgggtttgttttgttttgagatagagtcttggtctctcgaacaggctggagtgcagtggcgcggtctcggctcactgcagcctccatctcccgggttcaggcggttctcctgcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443719 - DNA, 1170 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggagggtgagtgtgggccgggggcggtgcatgagatgatggggcgagctgaggtccacccgggcgacgctctggacctgcgcgaaggccggcggtgcgcgactcgccccttcttggcgtctccccgggcgcgtctccccgacttctctccccgcgcaccgcccgctggtggcccgcgaaagggggccggtgggctgagggccggtggacgggagcccgggggtggttgggccgcgttcaggccgccctcagcccgtggctggtagccaggagggacagtgcggtaagcgctgctgaggcataccctctggtgataagcaatttattattaataacattatatcaaataccgacattgttgtggccgtattaggagccaggaactgtgcatcgtgctttatttacatcattatcccatttaatgctcccacaaaccctgtcaga

SEQ ID NO: 443720 - DNA, 2876 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443721 - DNA, 3107 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttccgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443722 - DNA, 2616 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtagtcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaat

SEQ ID NO: 443723 - DNA, 1883 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgtttta

SEQ ID NO: 443724 - DNA, 1640 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagacaggaacttaactagtggaataattgtgccattggtagatccatattataattgaaagcaactcagattgcagaaaaggagtgccccccagccatgacccataagcaaagaggtcagaaacaaatgaaaaagccaaaagtttcaagtatcagaaatctccgtaggtcacacgcaacttcctcatttatttctgtctattctgagatggtaattgtatgagaaagccctctattaataataaattcaggttttttg

SEQ ID NO: 443725 - DNA, 1847 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaaca

SEQ ID NO: 443726 - DNA, 3175 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtagtcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443727 - DNA, 3123 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggactcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtagtcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443728 - DNA, 2583 bp, Homo sapiens
agtagctctctgatagtttaatgaaaggagacctttttgtctccagaggggaaaatttcgtgttagaggggaactgtaattctttggggttcatttgttttgaagtcaaatatgactctgaatgtgctggcatgttttagttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtagtcctcggcctcccagggtgttgggattgcaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443729 - DNA, 2135 bp, Homo sapiens
ggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggaggagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcagtagctcacgcctgtaatcccaggactttgggaagctgaggcaggtggattgcttgagtctcaggagttcgagaccaggctggttaacatggcgaaaccctgtctttactaaaagtacaaaaaattagctgg

SEQ ID NO: 443730 - DNA, 2516 bp, Homo sapiens
  misc_feature (1907)..(1907): n is a, c, g, or t
aataatggcatagtaaaaaaaagatgggaaacaacccaaatgtccatcaatagtgactggttaaatacacatcggtctggctgcaaaatggaatagcatgcagcgctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaangtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcat

SEQ ID NO: 443731 - DNA, 2480 bp, Homo sapiens
  misc_feature (1871)..(1871): n is a, c, g, or t
aataatggcatagtaaaaaaaagatgggaaacaacccaaatgtccatcaatagtgactggttaaatacacatcggtctggctgcaaaatggaatagcatgcagcgctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaangtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcat

SEQ ID NO: 443732 - DNA, 2590 bp, Homo sapiens
  misc_feature (1981)..(1981): n is a, c, g, or t
aataatggcatagtaaaaaaaagatgggaaacaacccaaatgtccatcaatagtgactggttaaatacacatcggtctggctgcaaaatggaatagcatgcagcgctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagataccccaattatcaatagatgaactgaatagcagcatgtttgtttcacagatgtagaagttctcagtagaacactgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaangtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcat

SEQ ID NO: 443733 - DNA, 485 bp, Homo sapiens
cttaaaactaatctgtaattgtaaacatgggagattgttggacttgcatgtgctgagtaattgatattgcaaagaaataatctttctgttaaaatgtatttctatcagtaaatccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaat

SEQ ID NO: 443734 - DNA, 384 bp, Homo sapiens
tccttaataatcaaatatctcttttactttccacgcttttctgcgtggtgtacagggccaatactgtgcatggcacccgcttcaaatattggtaggttttctacaaaaattatcaacattttctaatctgaaaaaatgtgtttttctgttgtgactatgaaagatgaatgactgaaagatgtggctggaaattttctgagtatgttaaggtttaacatggtgctttctgttttatgtctttgtagcatcaaaatagtcctactttctcaagtcctagttggttgccactgtggccaaatactggccctgtcatttctctatttctaccctaacaacagcaactgaaatattaaaaaatcgtttcttttacaatatttgaaacta

SEQ ID NO: 443735 - DNA, 2465 bp, Homo sapiens
  misc_feature (1856)..(1856): n is a, c, g, or t
gcaaatgaaggcctgggagagcctgggctgattccatggagagggcttctaagaatcttaagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggccctgcagcctggtacactgcaactgataccaaagagatcagcactggaaaagcccaatggtgccaccccggtctttaatcccactgttttccactgccaacaggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaangtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcat

SEQ ID NO: 443736 - DNA, 2411 bp, Homo sapiens
  misc_feature (1802)..(1802): n is a, c, g, or t
aataatggcatagtaaaaaaaagatgggaaacaacccaaatgtccatcaatagtgactggttaaatacacatcggtctggctgcaaaatggaatagcatgcagcgctgatcagggtcggtgtacccgagagaactgcaagtaccttcaccctcctccacacttaaaaacgcagctggagattaatgggcggaacaatctgattcaacagaagactgccgcagccatgttcgcccagcagatgcagcttatgctccaaaacgctcaaatgtcatcacttggttcttttcctatgactccatcaattccagctaatcctcccatggctttcaatccttacataccacatcctgggatgggcctcgttcctgcagaacttgtaccaaatacacctgttctgattcctggaaacccacctcttgcaatgccaggagctgttggcccaaaactgatgcgttcagataaactggaggtttgccgagaatttcagcgtggaaattgtacccgtggggagaatgattgccgctatgctcaccctactgatgcttccatgattgaagcgagtgataatactgtgacaatctgcatggattacatcaaaggtcgatgctcgcgggagaaatgcaagtactttcatcctcctgcacacttgcaagccagactcaaggcagctcatcatcagatgaaccattcagctgcctctgccatggctctgactaacctgcagctcccacagccggcatttatccctgcagggccaatactgtgcatggcacccgcttcaaatattgtgcccatgatgcacggtgctacacctaccactgtgtctgcagcaacaacacctgccaccagcgttccgttcgctgcaccaactacaggcaatcagctgaaattctgaacagcagagttatggagtatcagaatctttccatggaaacctccatatggcctttctatatatattctcgtatgtcttattctaccaacacaacaataagcgtgttgcagtcaatgtattaagcaaagcaaacctgccagccagcaaattcaaataaaaaataaagcattaaaaatcaatggagatgttaaaacaacacaaatagaaaactagtaactaccatccatcctatttgaattatcaagcagaacatgaccataaaatttggtaacttgttacattactctttgtgattttctaataaccatgctaagtgtatttccacagtgagcttttggcttactatatacattcttggtggataaattgttcatctgtttttgaagtgttaccttactattttgtttacaagatagtctattgggttgattcaggatgtaacaaatatattcagtaccatttcttgtgttgtattgtgttgtgctgtgttaggtttttacatactgtagtgttttgctgtatatgtgtggtgtttgatttcaactaaagtgttattagtggggaacagaagtatatgtgcttaagaacatgacaggttcatgcaaatatgctctctttctttagaatatttctgtaggtttcttgggactgacatttaaaacgcctcacttttgaatgtgcacaaaacctgctcattaacatgcatgtgtataatttgtacctgcagatctgatgttgcataatacaatcaaattactagattttttaaagagagaaataattacctgcacaaagcagagaacttcataaaacattaacccctaattcactcttcttaaatagcttggcaaataagactttacctttaaatgaatttctcagcatttatactaaaaattatgtaangtgctcattagattttttgtgtgtgtggcttgagaatcccatctcctaaattgagtgtctaaaactgagccatttgtcatcttcagctgagaaactggtacttgggagcttaaaaatatgctaattacaagttataaatcaaacggagagatgggggcatggagatagtttttacgtactggaggaaagtgtgtaaaaccatggcaatgtcaccttttacacaaatgccattttccaaatgcaaatggctcatgctctttagactactctttgaataacaagtaagatgcaatctagcaaaagtcagtcagggtgaaagagaattggttgcaaatgaggacttccctccccaaatggacagtcttctctgttgatcacagagggagcctgagtacaggcttggagaaatggctaggacagggaacagggaagcacttacaattattccttgatttattcaaaagaactgggaaagatggttgtagttgtctttagcttcggttcaactgagtttcgttttgttaaacagttcagtgaaggagaaagcacctgtgatatatggcaagtgtccccctgcccaaactttaacatcagaccctctcacatcat

SEQ ID NO: 443737 - DNA, 1051 bp, Homo sapiens
ttgacggtgtcctgtgaagtacagaagtttttaattttgagaaaagttcaatttatctgttttttttcttttgttgcttatgcttttagtgttgtagccaaggcttcacctaacctaaagtcaagaaaatttactcttatattttcttctatgtgttctatacttttagctcttatatttaggtcttttttccatcttgtgttaatttttgtgtgtggtatgaggaaggagttccaacttcatttttttgcatgtgtatatcctattgtcccagcaccatttgttgaaaatactgtgcttttaccattgaactgtcggcaccattttcaaaaatgaactgacttacagcaagaggtttatttatggactctaaatctgctccatctatatctttgttatattagcccattctcacactgctacaaagaactacctgagactgggtaatttatgaagaaaagaggtttaattaactcatagttctgcaggcttaacaggaagcatgactgggaggcctcaggaagcttacagtcatgggagaaggtgaaggagaagcaagcaccttcttctcaggaaagagaatgagagagtgaaggggaaagtgccatgcacttttaaaccatcagatctcgtgagaactcactcactatcatgagaacagcaagggggaaatatgccctcgtgatccaatcagctcccaccagacccttcccctgatatatgaggagtacaattcgacatgagatttgggtggggacacagaaaaaaccataccacctgtctttatgccaggaccacactgtctgaataactgtagctttgtaataagtcttgaaattgggaagtgcaagccttccaactttgttgggtttcaagattgtattggctgtttgggatctgttgcatttccctgtgatttttaagatcatcctttcagtttctataaataaaccagataggatttgatagcaattgtgttgaatccgtagatcaatttgagaagtattgcctttttaacagtattaagtctttcaatccatgaacacaaaat

SEQ ID NO: 443738 - DNA, 925 bp, Homo sapiens
ctgtttctgacctcctgacctggcttcccttcctggcagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacatcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443739 - DNA, 1033 bp, Homo sapiens
ctggcttgccccgggtccttaagccagcgacagtttttattgccgaacccaggctggaagcgggcggccctaggagccgcgcacaacagcgcaagcgggctggataccgggagccgattccagggcgcccacagaagcagaatcagaggggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443740 - DNA, 2443 bp, Homo sapiens
ggccaggggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacagacagtttatgcagatgtgcacatgaaaactgaatatccctgggaggcctcccacactaacagaactctggcttccagaagctgcagggcctgctctctaagcacatgcctgccagatgtacaaagagaaagtttgaacttgggcctatcccgcctttgagggagggaggctggagccatatggctggagggaagttatcttccccgtctgccctccattggggctgatatacattatctgcttctttgctcatcttattccaaacccttccccaggccagaatggggaacagggctatgtgggttggcccccaaaatgaaagcataaactggatagaggagggtggaagtttggtcacctgtgtggtccatacccttccccagctcccataggaatctacccatttcctgcagaagccagagtcatggtaaggctgtttcctatctgccccaattgtgacctgtcctctctggcttggggtccccaaatctctttcctcattctccttacctatcccagggaca

SEQ ID NO: 443741 - DNA, 1647 bp, Homo sapiens
ggccaggggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagactggatgcctttgctgggccatgctattctcagacctcccgccttcacccccagggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443742 - DNA, 1505 bp, Homo sapiens
ctggcttgccccgggtccttaagccagcgacagtttttattgccgaacccaggctggaagcgggcggccctaggagccgcgcacaacagcgcaagcgggctggataccgggagccgattccagggcgcccacagaagcagaatcagaggggtaggcgggggtggggcgtgctgttcggcgctgtggccaaaatccgcccggcgctgaaagaggggacgtgggtgtgagtcccagcatcagccagggaatccgcccctagcttgttcttcgcccagctgggctccaagacgccctctgcgggcccatagctcctaccgcgtccactgcagcggacccgctttaataatgtcgctggaaagtgacacgcgatttattattaaagtaatgcgggcgcagggacgggaaaggtttaataaacgtgctgagatgccgaggattattcaccgcaaataaatgagagcgcgggcggcgttttaataaataatttcccgctgctcccgggggaaggcaggggagggggagggagggggagggaggaggagggggaggctgagccgctgccagaactcccggtttcgcctgcccacgggcttccaagccatccccgcgttttgtgtcctaggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443743 - DNA, 1020 bp, Homo sapiens
ccactactggctgacccactactagcctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacagacagtttatgcagatgtgcacatgaaaactgaatatccctgggaggcctcccacactaacagaactctggcttccagaagctgcagggcctgctctctaagcacatgcctgccagatgtacaaagagaaagtttgaacttgggcctatcccgcctttgagggagggaggctggagccatatggctggagggaagttatcttccccgtctgccctccattggggctgatatacattatctgcttctttgctcatcttattccaaacccttccccaggccagaatggggaacagggctatgtgggttggcccccaaaatgaaagcataaactggatagaggagggtggaagtttggtcacctgtgtggtccatacccttccccagctcccataggaatctacccatttcctgcagaagccagagtcatggtaaggctgtttcctatctgccccaattgtgacctgtcctctctggcttggggtccccaaatctctttcctcattctccttacctatcccagggaca

SEQ ID NO: 443744 - DNA, 562 bp, Homo sapiens
  misc_feature (18)..(18): n is a, c, g, or t
ctttgtgctctgaggatncctcagacagcggacccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443745 - DNA, 1919 bp, Homo sapiens
ggccaggggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaaaagctggaggagggtagggagagaagctgagaccaggaccggtggggtacaaaggggcccatgcaggagatgccctggccagtaggacctccaacaggttgtttcccaggctggggtgggggcctgagcagacacagaggtgcaggcaccaggattctccacttcttccagccctgctgggccacagttctaactgcccttcctcccaggccctggttcttgctatttcctggtccccaacgtttatctagcttgtttgccctttccccaaactcatcttccagaacttttccctctctcctaagccccagttgcacctactaactgcagtcccttttgctgtctgccgtcttttgtacaagagagagaacagcggagcatgacttagttcagtgcagagagataggtgaggccagctcgagatcttataccactctgtattggacaaaggctagcacagggctaggcaccaataaagatttctaatgatgcacag

SEQ ID NO: 443746 - DNA, 2154 bp, Homo sapiens
ggccaggggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443747 - DNA, 1732 bp, Homo sapiens
ctggcttgccccgggtccttaagccagcgacagtttttattgccgaacccaggctggaagcgggcggccctaggagccgcgcacaacagcgcaagcgggctggataccgggagccgattccagggcgcccacagaagcagaatcagaggggtaggcgggggtggggcgtgctgttcggcgctgtggccaaaatccgcccggcgctgaaagaggggacgtgggtgtgagtcccagcatcagccagggaatccgcccctagcttgttcttcgcccagctgggctccaagacgccctctgcgggcccatagctcctaccgcgtccacctgcagagcagaggctcctcaccaaaagccccaccccaccggagagggtcacgcaggtcccggggaatccgcactccttaatcgcgttagccgactttgtaggtgttcaggagcagcctcctagcagcctcagttttcccctccccgccctgctggttcaagcaccacagcctggaatgggagaactgttgtccaccgccccctccctccccgcaccccgcctctgctgcagcggacccgctttaataatgtcgctggaaagtgacacgcgatttattattaaagtaatgcgggcgcagggacgggaaaggtttaataaacgtgctgagatgccgaggattattcaccgcaaataaatgagagcgcgggcggcgttttaataaataatttcccgctgctcccgggggaaggcaggggagggggagggagggggagggaggaggagggggaggctgagccgctgccagaactcccggtttcgcctgcccacgggcttccaagccatccccgcgttttgtgtcctaggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgcccggctgctcgtcaccgcgaaggctccaaagaagtgttgcgcagccgtgctggtataactgagggtgtcctggcgaagcccagcccctggcgccctggtgaccgggggggtcgatgtgcggactgggcagaactggagcccgaagctggagagcgcccctcaaaaagaagcctggaagcccgagagatgaacccgactcagagagggccaagactgcagaccttggggaccgaggacaccctcaccacgctggtgggggctggggggatggcgcgggcggtggcgtgcggggaagcgcctggggaacacctggctctgcaagttttgtgccttagcggaaagaggcgacatctctggcaagttgggagtacaggaagtagcgaaggagtgccatctggtggatccttctggtagtgacactcagacctgggccaggggccttgagacaatttacttgactggaaaaatctgaataaaaaaaagatgcttca

SEQ ID NO: 443748 - DNA, 1453 bp, Homo sapiens
  misc_feature (1443)..(1443): n is a, c, g, or t
ggccaggggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactagggtgcccgaacgcgctgatgccccgagtgctcgcagggcttcccgctaaccatgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactaggtccagagctctggcccatgggggtgggtgagcggctatagtgttcatccctgctcttgaaaagacctggaaaggggagcagggtcccttcatcgactgctttcatgctgtcagtagggatgatcatgggaggcctatttgactccaaggtagcagtgtggtaggatagagacaccgtatagtagggggatcctnagagtcacct

SEQ ID NO: 443749 - DNA, 3187 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggcaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443750 - DNA, 3052 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443751 - DNA, 2542 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443752 - DNA, 3194 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacgcggggagcacccatcacatgctgggtgtcagggtgacgctggcatgtcaggatcctgtgatgggcccagggcccagcacaaagtcagacaaatctctctcagtgcgtactacgtgtcaagcactgtgcaaggatgggcaagaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443753 - DNA, 1978 bp, Homo sapiens
ccatccgcgtctgtctccccgcaggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443754 - DNA, 1704 bp, Homo sapiens
ctacttgaggatccctgcaactgtttcggatcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443755 - DNA, 1701 bp, Homo sapiens
taggctagtacgaggcctgggtggtgtgctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443756 - DNA, 1566 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcactccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443757 - DNA, 2045 bp, Homo sapiens
acatagcacatggcaagggggaccccagagaaagcggcccagaaggggcaggaggagggcttcccagagccatagcagcctagagcaggggccagagctgcactttgcagatggagagcccttgcccgggaccgccctgtggggtgggagtctaggcctctgcccccactcacggctccactccatccccacagttattggctgaccttgctgggaggatggagtctcctgggtgagacagaggccctttgagggtgggtgctggccttgccttccttgaggcctctccctgcaggacgccccctctagcctctccatcagttccccccaggcccaggcccacaccaggcagaagagtcccgacactggtggcagaggcaggggtgagggatgggggcacctacctctttgccaccccatccaggccaggatggagcctccactcccagcccaggaccaagaaggcagggctgataaccccatgacacagaatcggatgtcagaggctcaaggaaagactgcttggcccatagccacacaggagtcaggaatgtggagggaatgaggcttggagcaatccaagagcagagctgcagggcactcggagctgctctggcccattctctacctgctaaaggcctcagagaggggcagggttgacccaaggtcatgcagcaggtggggcaggctctgtactcccgagcctcagtttcctcacgttaccccatccatcctccctgaaaacgccatctccatcagccttgaggggcagaggcatgacccaaaaggcctggctgggccctctaggtggacagtcctagcaaccatggctcaatgccaggcctggctgtgatgagcccgtttgctgcaagaggagactgaggttcagagaagtcgagggtccatggctgagcagagctggcaccaaagcccacatgggccagcacaacagggtaggggatggggcaggggcagagtggcagtgctgatggcgtcggccctctctaggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggcaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443758 - DNA, 616 bp, Homo sapiens
tctcaggcttctcctgcccaaagggacactgctcaggctgcctctacacgtgaaatccccagagcctcctctccccatcgaatcacccaaagggacacctccagggcctcatccacccaacaggaaatctccagggcctcatccaccctacaggaaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443759 - DNA, 1259 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacgcggggagcacccatcacatgctgggtgtcagggtgacgctggcatgtcaggatcctgtgatgggcccagggcccagcacaaagtcagacaaatctctctcagtgcgtactacgtgtcaagcactgtgcaaggatgggcaaggtagacgttgccccctgtagaccctcacagtgtagggagatccagagcctcagggtatagggagagacagccgcaggatggcgtagatgtgggttgaatgagaacagctctggaggggtgggtgatgtttggacaggtggatgaacaaggtggtgtgttcatctggccccccaggtatgcaagggagaaggggctgatctgactgctagggggctccgggctgactgcagatccaccagccagcattctcagctccggcctctttctctcagccaatgggctgactccacaaattacttcctgacctcctacatgggatagagagggcacagggccaggaacagcgtg

SEQ ID NO: 443760 - DNA, 424 bp, Homo sapiens
ccatcgagccggggcagcagagctttgtgcaggtacctggcatgcctgtcacccctcgggcctcccagctcctggaacttcctctccgcctttcttcccaccatgactccagaggagatgagactcccagagtcaggagggagacagcctgggtgcacgggagagggagagacagagaaggcattgctcagggacactgacaaggatgtggccctgtcctcctcctctgccccagacaggtccatgtctttctttccactgtgaggactcaggggtgggaactcttaattctagccgatatttgaaggcagcaggtggggtggggtgaagagcagctgcccatgccgcgtggccctacctacccatgcagtcagagtgtccccatccgtctccgagttcctgctccagttagacagctgccacc

SEQ ID NO: 443761 - DNA, 769 bp, Homo sapiens
agtgcaggaggggacacgctgtgccacagttcacatgccacaagccagtgctgccttgggacagtgatggctcctccaccaaatatcagattgaagcatgtggaatatgccaggttctgacctaaaaccccagcattttcatacgatctattgtgcatctactatgtgccaaagccctatcatgctaggcacttggggacacactcaggccctgccttcctggagctgatactgtgatgagggaggtgacaataaacatgtacatgtacacagataaatctataatttcgggtcttgctgggtggtttcggggctgcagcctaacatgtgtcatgggctcatcccttatgttaacacacggaggcccggggacttgcacagggtcacttggcaggtgagtggtggaagggaagttcgaacctaggtcctctgacgcctctccccctctgcagcaccgtcctgcctgccccaccactatctttggctgtgggtgagggcggggctctgttaggtgcagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggtatggctctcgccccgcccctgacactagtccccaccccgagag

SEQ ID NO: 443762 - DNA, 3034 bp, Homo sapiens
  misc_feature (7)..(7): n is a, c, g, or t
  misc_feature (23)..(23): n is a, c, g, or t
aacccanctcactacagaaccanctctcggaatccgggtaaagccttaagagcagcgcaattcctcgtgcactgttggcctactgtatataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443763 - DNA, 2678 bp, Homo sapiens
agtgcaggaggggacacgctgtgccacagttcacatgccacaagccagtgctgccttgggacagtgatggctcctccaccaaatatcagattgaagcatgtggaatatgccaggttctgacctaaaaccccagcattttcatacgatctattgtgcatctactatgtgccaaagccctatcatgctaggcacttggggacacactcaggccctgccttcctggagctgatactgtgatgagggaggtgacaataaacatgtacatgtacacagataaatctataatttcgggtcttgctgggtggtttcggggctgcagcctaacatgtgtcatgggctcatcccttatgttaacacacggaggcccggggacttgcacagggtcacttggcaggtgagtggtggaagggaagttcgaacctaggtcctctgacgcctctccccctctgcagcaccgtcctgcctgccccaccactatctttggctgtgggtgagggcggggctctgttaggtgcagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443764 - DNA, 1704 bp, Homo sapiens
aaaaaacccaactttcttgtacaaagttgtgcggccgctcgcgatgactgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443765 - DNA, 2090 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcgggtgagatggacagtcacgtgctaacccacctggcccaggggctgctgctgggccggggcctcttcctggcctgggagggagcaggcctcgggaaactcctggcaagccatgtgtgtctggaatgcctcggtctccccttctgtatgaccggagcaggactgctgagggtgacgctctcggtctctcaagtcagagggcttagcacatactggctgtgtggccttgggcaagtcactttagttttctgggcccaaaggtggcctaagaaaggactctgcgccacagggtgcttctgggcagccaatgaggtgctgtgtggaagctcttcacacagcctggcagctggtgcctccttgataaatattagttt

SEQ ID NO: 443766 - DNA, 1473 bp, Homo sapiens
agagacgaggtctcgctctgtcaccaaggctggagtgcaatgatgtgatctcggctcactgcagcctcctcctctcaggttcaagcgattcttgtgcctcagccttcccagtagctgggactatgggtgtctgccaccacacgtacctggcatgcctgtcacccctcgggcctcccagctcctggaacttcctctccgcctttcttcccaccatgactccagaggagatgagactcccagagtcaggagggagacagcgtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacca

SEQ ID NO: 443767 - DNA, 1475 bp, Homo sapiens
acccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaagctgtacctcacccgtagctgtacctcacccgtagctgtacctcacccgtagctgtacctcacccgta

SEQ ID NO: 443768 - DNA, 1473 bp, Homo sapiens
tagtccatgaggtactttggctccatccccctcaaaaacaaaacaaaaaatccatttaaagtgtcctcctagaaaagcctcagaactgccttcaactacatctgtcacctttatagaatattttgaaattctggaagaggatgggaaacaaaattctaatttagctagagctgtgatccccaaataagtgctgacaaaattgtctaccacagaaaggccgtccttgtcatcttgtaggcatcactgctgctaaatcacatcagtacatgccttctgtggggagatggcagggggcaggggcaggaccaggggatgggattagataaagtgtgataatgtcctttagataaaagaaatcctacgctatagaacaaggttctgtactcttgagttggtgtctgagatcacctgcacagtgttacagagattttccactccataaatcactctaaaagagtttgcataagactcggtagacctgtgctattcaatgtggcagtcaacagccatatgtggcgatgactactcaaagtttggcttgttcaaatcgagactgtgttgtacacatacaatacacaccagattttgaaggcttggtaccaaaaaggaatttaaaatatttcaccaatatttcatattgataacatgctgaaatgacactattttggatgtactaagtaaaatattaacaatttaatatatttatataattgaaattaaaattcttttcacccatttttatttttttaaaaatgtggcccctaaagaacttcaaattagacatgtggataacgttatacttctattggacagccccactctagacttacatggtgtggggtaggcagtgaaatccgtaaataggaaacgcaattctgcaaagtatctaaatagacagaaacaacacaaatatttttgctggagtcaggagcactgtgaggcacagaacatctcccagaaagcagattttttttttctgccgaaaaaccaatatatatatgtatgatcccaattaaaagacaaaagcaaatgagccccaaactgcctgtcttcagctttgcctgggagctgctacctttgctcttctagcatcttctaggtaccaaggatattagccacttgagggtgttgggcatatttgtttcattgtaggcaaaatcctcttgtggtttcccctccccaggtattgttgagtctgttcaaagctgggtgtgttgaaacactgcacaaatcctgccactcttgatgtgccgcttgtctcagccttggcagaggctgagtctgttcctgtgcccacctgtccagcaggttttgatgttggctcctgaaagagtttgtatttattttattttgcactagtcacagttgttgttaaactgtatcaaatgttttgggagattatttgcctgagatggaaagagagatggatgatttattgcttcaattgttttaaattaaaagctattctcacaa

SEQ ID NO: 443769 - DNA, 742 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatgtgagtcttggatggccaggctcctggggacagggggcccaaggggcagtagagggtaattgttatgattgtggaagaactgttgggtactgattaagagttctgggtttgtatcctacctgtccatctgctagggatgtgatttagggcaaattgcttgagctttttgggcctctcttttcacaactataaagtattgttttacttacacttgtgaagtttaaatgagatttgttattgttgtttttatgttaatccctagtacagggcctgctgtcctaaacacccaggacacccaggaaatggtagttgctgtttcattttcctcatctccagtctcaaagggaagccaggccaatgagaacagctacttgccatcaggctatccctttaggagtcactgaaagggccccagggtgtggtgaggagagtcccaggtgctaggattaggggaagatctaacttttgagttcatctttgccaccagcttgctgcgtgaccacagaaaaa

SEQ ID NO: 443770 - DNA, 4272 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443771 - DNA, 4272 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443772 - DNA, 4012 bp, Homo sapiens
atttatataatatataaatccaaaatcttatgataaagatcgtaagggtcagcacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443773 - DNA, 4461 bp, Homo sapiens
  misc_feature (4222)..(4222): n is a, c, g, or t
  misc_feature (4224)..(4225): n is a, c, g, or t
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggagtggaattccgaataaattggcattaccactanannaaataataataacaaataataaaaaacttcaaggggggccccgtccccaatctgcctatattgagtcgattacaatcacttgccgcgcttacacctcttactggaaaccctgcgttcccactaaaccctttcaccaatcccctgtgcaacttcctaatacgaaaagccgctcccaacccctccaaaaattgccacctcatggcaatgcactttaaccgaaattttgtaaaatccgt

SEQ ID NO: 443774 - DNA, 4252 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggagtcgcatcaccagcgcgccacgaccccatccccgcctccttcgtcgacgcggccgcgaattta

SEQ ID NO: 443775 - DNA, 3950 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443776 - DNA, 4639 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatgggtaagctggggctggggtgacctgggagcaggaatggtgtcagagggttgtgggggtggtttagaatgccccagggagttgggtggatggaatggctttgaggcagagggaaagaggtctgtgccaggagatggcaagtctcgtcatctccatgagcctcagtgccccatcagcaaagacgaaggagtgcccgttgtcagccacccacagttgtcgctatcggaaagtggtttggaagattggctaacatccgggtgcgaggaatcatcagcagggaggccaagtttggggagcttgagaggagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443777 - DNA, 3782 bp, Homo sapiens
ccacctcagcctcccaaagtgttgagattacaggcatcagccaccatgcctggcctgagatctttttaaaattattttttatttctaaagcaaagaaacttgacagcagagttgtattgactgagttgcacattgagcctagccctagcccttttaaggggcactatttggaacggcctgggctccccagatctaaacttctcgctcttcaccatccagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatgggtaagctggggctggggtgacctgggagcaggaatggtgtcagagggttgtgggggtggtttagaatgccccagggagttgggtggatggaatggctttgaggcagagggaaagaggtctgtgccaggagatggcaagtctcgtcatctccatgagcctcagtgccccatcagcaaagacgaaggagtgcccgttgtcagccacccacagttgtcgctatcggaaagtggtttggaagattggctaacatccgggtgcgaggaatcatcagcagggaggccaagtttggggagcttgagaggaggtatggaccaagaggagggtttttttgagaatccagaggcttttattgtctgcgtcctttctcagctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443778 - DNA, 3343 bp, Homo sapiens
atttatataatatataaatccaaaatcttatgataaagatcgtaagggtcagcacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagaggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443779 - DNA, 1965 bp, Homo sapiens
gaacgagaattgatagcatatttgagtctgtataatgctgactcgtttgcctgtggaaagatgtagggccccacagagagagcgtcgacgctctctctgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443780 - DNA, 2064 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443781 - DNA, 953 bp, Homo sapiens
agcactttgggagactgaggagggtggatcacctgaggtcaggagttcgagagcagcctggccaacatggtgaaaccccatctctactaaaaatacaaaaattagctgggcgtgatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443782 - DNA, 2767 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctggtgcgctgccccacctggagagcccgccctcctccctagccctccagacctttgttttcccacctgtaaagtggggcagtgtagccctcacttgaaatggtacttctggaggcatctgtgagccagagccctgctccgatggctgtgggggagaggggatgatttttctaacctgcctccacccttcccggtgccatgggaggcagacaccaaggcagcaagttctggggtctccagctgcagtgggtggccgctgattgcttctctctgtccagactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggtacgggaacctgctcacaggaagaggagagagccccaggaagaaggggggactgttagcagcgtagaattgaggagttggaagagacctttagaacagctggtcattatgccaactgggtgtccacactaagttcggcatcaatatggtgacttcctgggagcagggcactaccagcttacctaaggatgggtgaactggcccaggtcagaaatgaagcaggtcagaactcccatgctgatcggtagtgggactgcacctgggcagcatagcgagcccttggctcttaaaaaa

SEQ ID NO: 443783 - DNA, 1274 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtgaggctttgcaggggagggatgt

SEQ ID NO: 443784 - DNA, 358 bp, Homo sapiens
ggaagaaacgaagttagagggcttagacactgaggggacagaacatctccatgtgcactctcgtctcttatagtctgcgacatgtgtcaatggggagggccctgcatcgtctgctaacctgaaggatctggaggtaagaggccctgggccgtggcccagtgaccctgcaggccagccctccaacctcctcccacagcgggggctgggtgcccctctgccagctgagacagcccacacaccccccaaccctaatgattgctctctctacctctccccccaatcctcctccaactcctcctctctgcatgcgcctcagagccggtaccaacagctagcggtagccctggactccagctat

SEQ ID NO: 443785 - DNA, 148 bp, Homo sapiens
gtttttcccttttcgcctcctgtagattcaggacattctgaaggtgctggtgtccgaccttaaccgttccaatggggtagcgctccccccattggacaagtggaaggtgaggcagtgccgagacccctctctggcttgctctctccag

SEQ ID NO: 443786 - DNA, 611 bp, Homo sapiens
  misc_feature (587)..(587): n is a, c, g, or t
cagctcgactctagagagtcccctccagactgccttcagaccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggagtctgaagcngtctggaggttagcgctcgctcgt

SEQ ID NO: 443787 - DNA, 4353 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443788 - DNA, 3819 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaaggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443789 - DNA, 3666 bp, Homo sapiens
gttccgtcctgtcctctggagaatgtttctttccttctttttcagcacttgcttgggtttcctcccaaaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443790 - DNA, 4409 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggtatagctgaggctataccaccccaaaattcccacagacacttgaagactcaaaagaaacacccagaagggttgtgaagaagggcactcacaagcttatttcaggatcaaaaatgagcaggctaaaacatcctgagctgacagagcaggaacagacaagaaggaaaaaacacctgttacggttacatgccaagccagtgtacgctagcaacctcagggtcccaaagcagtaacacagagtttaatcatattcttctctggtaattagcggttagacacagg

SEQ ID NO: 443791 - DNA, 4722 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatgggtaagctggggctggggtgacctgggagcaggaatggtgtcagagggttgtgggggtggtttagaatgccccagggagttgggtggatggaatggctttgaggcagagggaaagaggtctgtgccaggagatggcaagtctcgtcatctccatgagcctcagtgccccatcagcaaagacgaaggagtgcccgttgtcagccacccacagttgtcgctatcggaaagtggtttggaagattggctaacatccgggtgcgaggaatcatcagcagggaggccaagtttggggagcttgagaggaggtatggaccaagaggagggtttttttgagaatccagaggcttttattgtctgcgtcctttctcagctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443792 - DNA, 4628 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctggtgcgctgccccacctggagagcccgccctcctccctagccctccagacctttgttttcccacctgtaaagtggggcagtgtagccctcacttgaaatggtacttctggaggcatctgtgagccagagccctgctccgatggctgtgggggagaggggatgatttttctaacctgcctccacccttcccggtgccatgggaggcagacaccaaggcagcaagttctggggtctccagctgcagtgggtggccgctgattgcttctctctgtccagactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443793 - DNA, 2974 bp, Homo sapiens
atttatataatatataaatccaaaatcttatgataaagatcgtaagggtcagcacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagaggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggagatggactggaccgggaggaggaggaggatgaggaggaggaggaggaggaggcggtggcagtacctcagcccatgccaagcatcccggaggacctggagagccgggaagccatggtggcatttttcaactcagctgtagccagtgccgaggaggagcaggcaaggctacgtgggcagctgaaggagcaaagggtgcgctgccggcgcctggctcacctgctggcctcggcccagaaggagcctgaggcagcagccccagccccagggaccgggggtgattctgtgtgtggggagacccaccgggccctgcagggggccatggagaagctgcagagccgctttatggagctcatgcaggagaaggcagacctgaaggagagggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443794 - DNA, 1834 bp, Homo sapiens
ggctaggtagaggccgggtgtttaatcggccgaggtgcaggcgaaggatactgaaggagagggtagaggaactggaacatcgctgcatccagctttctggagagacagacaccattggagagtacattgcactgtaccagagccagagggcagtgctgaaggagcggcaccgggagaaggaggagtacatcagcaggctggcccaagacaaggaggagatgaaggtgaagctgctggagctgcaggagctggtcttacggcttgtgggcgaccgcaacgagtggcatggcagattcctggcagctgcccagaaccctgctgatgagcccacttcaggggccccagccccccaggaacttggggctgccaaccagcagggtgatctttgcgaggtgagcctcgccggcagtgtggagcctgcccaaggagaggccagggagggttctccccgtgacaaccccactgcacagcagatcatgcagctgcttcgtgagatgcagaacccccgggagcgcccaggcttgggcagcaacccctgcattccttttttttaccgggctgacgagaatgatgaggtgaagatcactgtcatctaaaagccggctactgtcagcaaagcctgaagaagtggggctggataccctgcccccaccatatccctaccatcccttctcagtcaaccctttacccttacagtagcaagcatagacccctgtctaacgggggtagacaggtgcagatgaggtgaagatcactgtcatctaaaagctggccactaaattaaaaaaaaattaaaagttatgggattaaaaaaagttatgggataaaaaaggttatgggtaacttatggtataaaagttatgaaaaaaggccaggtgcagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaattatgaaaaaagttatgggattaaagaaagtcaggataaaaattttaaaaagcaggccactgtcagcaaagcctggagaagtggggccggaggctccgcccccatcatgtgcctgccaccccttcccagtcatccctttactcttacagtagcaaataagacccctgtctaatggggggagacaaatgtgtagacccttagccaccttggccagggctgactccttaaatttctggatgatgatgattgttatttaatagccagaggctcatataattggcctctttggaagaggcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccata

SEQ ID NO: 443795 - DNA, 2492 bp, Homo sapiens
cgcagtggttgccgggatcgcgctgatgtggccccaaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaatggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatggatgaaaccaagactttctcatcaaccgagagcctgcgacaactctcccaacagctcaatggtcttgtttgtgagtctgcgacatgtgtcaatggggagggccctgcatcgtctgctaacctgaaggatctggagagccggtaccaacagctagcggtagccctggactccagctatgtaacaaacaaacaactcaatatcacgatagagaaattgaaacaacagaaccaagaaattacggatcagttggaagaagaaaagaaagaatgccaccaaaagcagggagccctaagggagcagttacaggttcacattcagaccatagggatcctcgtatcagagaaagctgagttacagacagccctggctcacactcagcatgctgccaggcagaaagaaggagagtctgaagatctggccagccgcctgcagtattcccggcggcgtgtgggagagttggagcgggctctctctgctgtctccacgcagcagaagaaggcagacaggtacaacaaggagttaaccaaagagagagacgccctcaggctggagttatacaagaacacccaaagcaatgaggacctgaagcaagagaaatcagaattggaagagaagcttcgggtcctagtgactgagaaggctggcatgcagcttaacttggaagaattgcaaaagaagttagagatgacggaactcctgcttcaacagttttcaagccggtgtgaagcccctgatgctaaccagcagttacagcaggccatggaggagcgggcacagctggaagcacacctggggcaggtaatggagtcggttagacaactacaaatggagagagataaatatgcggagaatctcaaaggagagagcgccatgtggcggcagaggatgcagcagatgtcagagcaggtgcacacattgagagaggagaaggaatgtagcatgagtcgggtacaggagctggagacgagcttggctgaactgaggaaccagatggctgaacccccgcccccagagcccccagcagggccctccgaggtggagcagcagctacaagcggaggctgagcacctgcggaaggagctggagggtctggcaggacagcttcaagcccaggtgcaagacaatgagggcttgagtcgcctgaaccgggagcaggaggagaggctgctggagctggagcgggcggccgagctctggggggagcaggcggaggcgcgcaggcaaatcctggagaccatgcagaacgaccgcactaccatcagccgcgcactctcccagaaccgggagctcaaggagcagctggctgagctgcagagcggatttgtaaagctgactaatgagaacatggagatcaccagcgcactgcagtcggagcagcacgtcaagagggagctgggaaagaagctgggcgagctgcaggagaagctgagcgagctgaaggaaacggtggagctgaagagccaagaggctcaaagtctgcagcagcagcgagaccagtacctgggacacctgcagcagtatgtggccgcctatcagcagctgacctctgagaaggaggtgctgcataatcagctactgctgcagacccagctcgtggaccagctgcagcagcaggaagctcagggcaaagcggtggccgagatggcccgccaagagttgcaggaaacccaggagcgcctggaagctgccacccagcagaatcagcagctacgggcccagttgagcctcatggctcaccctggggaaggtacgggaacctgctcacaggaagaggagagagccccaggaagaaggggggactgttagcagcgtagaattgaggagttggaagagacctttagaacagctggtcattatgccaactgggtgtccacactaagttcggcatcaatatggtgacttcctgggagcagggcactaccagcttacctaaggatgggtgaactggcccaggtcagaaatgaagcaggtcagaactcccatgctgatcggtagtgggactgcacctgggcagcatagcgagcccttggctcttaaaaaa

SEQ ID NO: 443796 - DNA, 391 bp, Homo sapiens
gcctcatggcctccttactctcaccaaagcaatttttccctcaggggggctcccatcttcttacacagagaggcagctgaggcaggacagtggggctaactgtagaccaggcgagggcacgggctgctggggtggccctgcttccccagtgtacatattgtatctgtgtaacattttgtatattccaggggtagggccgccccctgtatcatacctagcagaggttggagctggcacatggggaggaggttctaataattatttggggctgggaaacttatttattgatagcataggacagaggaaggaggcggggatggggtcgtggcgccctggtgatgcgactcctgtttattttgctttttatttcggaataaatggatttagccat

SEQ ID NO: 443797 - DNA, 938 bp, Homo sapiens
atcagaactgacatggccattttcatttatacagcaatattgtgtttatcatttaaaatacttgaacaaacaagtgtgatatgtctttatctgagacctatacatggtatggacttcatatactgccacaggatgtgaggaaagaaaaggaaatcaattctgactgtgttgcctttattatctggataatactgtcttgtcacctcagattggggttgtgcactttagatctgaactgtacagtgttgcaaatcaacatgtgtttctgtaaaagcttgtacaatatattattgatatgtctttttctgtgtggtagctgtattgaactttgatattatgaaaactacatttgcatctgttcctgttctctctctctttcctaactatatgccctccacatcggctctaatagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacacat

SEQ ID NO: 443798 - DNA, 1035 bp, Homo sapiens
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctatggctctggggattccgagaatcccggcacaggtaggaaagagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcc

SEQ ID NO: 443799 - DNA, 3325 bp, Homo sapiens
  misc_feature (3320)..(3320): n is a, c, g, or t
  misc_feature (3325)..(3325): n is a, c, g, or t
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttttaaaagtcctttcttaagtttagaatacctctctaagaattcgtgacaaaaggctatgttctaatcaataaggaaaagcttaaaattgttataaatacttcccttacttttaatatagtgtgcaaagcaaactttattttcacttcagactagtaggactgaatagtgccaaattgcccctgaatcataaaaggttctttggggtgcagtaaaaaggacaaagtaaatataaaatatatgttgacaataaaaactcttgcctttttcatagtattagaaaaaaatttctaatttacctatagcaacatttcaaatgtatttaaatacatataattttacaaaaggaaaatatatatattaaaaaagatatcctattttgtaacatatagatttttattttatataggttatacaaactgcgggggcngaatn

SEQ ID NO: 443800 - DNA, 1558 bp, Homo sapiens
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacaggtaggaaagagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcc

SEQ ID NO: 443801 - DNA, 1541 bp, Homo sapiens
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacaggtattgtctcatcgaaaataataaagctcttttttcgtttacaa

SEQ ID NO: 443802 - DNA, 3295 bp, Homo sapiens
tcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacacat

SEQ ID NO: 443803 - DNA, 2363 bp, Homo sapiens
atgtcccctatacatcaccatcaccatcacctggttccgcgtggatccgaagcttcgaattctggcttttggtctttcgggtcggaagatggctctggggattccgagaatcccggcacagcgcgagcctggtgccaagtggctcagaagttcacgggcggcatcggaaacaaactgtgcgccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacagggcatcctagatacttcaatcaactttctactggtttggatatggttggattagcagcagactggctgacatcaacagcaaatactaacatgttcacctatgaaattgctccagtatttgtgcttttggaatatgtcacactaaagaaaatgagagaaatcattggctggccagggggctctggcgatgggatattttctcccggtggcgccatatctaacatgtatgccatgatgatcgcacgctttaagatgttcccagaagtcaaggagaaaggaatggctgctcttcccaggctcattgccttcacgtctgaacatagtcatttttctctcaagaagggagctgcagccttagggattggaacagacagcgtgattctgattaaatgtgatgagagagggaaaatgattccatctgatcttgaaagaaggattcttgaagccaaacagaaagggtttgttcctttcctcgtgagtgccacagctggaaccaccgtgtacggagcatttgaccccctcttagctgtcgctgacatttgcaaaaagtataagatctggatgcatgtggatgcagcttggggtgggggattactgatgtcccgaaaacacaagtggaaactgagtggcgtggagagggccaactctgtgacgtggaatccacacaagatgatgggagtccctttgcagtgctctgctctcctggttagagaagagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggggactaccgggtttgaagcgcatgttgataaatgtttggagttggcagagtatttatacaacatcataaaaaaccgagaaggatatgagatggtgtttgatgggaagcctcagcacacaaatgtctgcttctggtacattcctccaagcttgcgtactctggaagacaatgaagagagaatgagtcgcctctcgaaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacacat

SEQ ID NO: 443804 - DNA, 533 bp, Homo sapiens
  misc_feature (11)..(11): n is a, c, g, or t
aacatacttcncaatttcttcaggatttaaaatcttgagggattgatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443805 - DNA, 1336 bp, Homo sapiens
  misc_feature (1112)..(1112): n is a, c, g, or t
  misc_feature (1120)..(1120): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaatttgtggggggcttgggccccggaaaaagtttttaaaccaattcggtggggggcgggggccccntgggtaangttgaacatggtgtcatatagctgtggttatctagaaggaagaatcggggtcctagaagtaagtgtcgtgggttgtttcacccaattaaaaaaaaggcgggggggaacccgagtgtttttggaaaaaatcccgaaatagagatcggagaggaaaaaagggcatctactacacaaggggattcaaggagacacgcatattcaaaataagcgcgtgtg

SEQ ID NO: 443806 - DNA, 1370 bp, Homo sapiens
  misc_feature (1129)..(1129): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaaaaaaaaaaaaaaaaaaaaaaaaaaaaaaaaaaaaaaaaaaaaaaaaaaaaaaccaaaaaaaccaaaaaaaactacacacancaaaacttaaacataacgcatcaccccactaatctaatctatttcgcctattgcccatttttttctaaattcccacaattcagtgccacttggcccaaattcgcgttaattgggcatttccccttataagggccttattcacattccgggtaaccggtttaccctagtgggcttaaataaaccgggtggtcccaattaaatttcttaacattgttccccttgggcttccttgggctttccc

SEQ ID NO: 443807 - DNA, 1327 bp, Homo sapiens
  misc_feature (1086)..(1086): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaaaaaaaaaaaccaaaaaaaccaaaaaaaactacacacancaaaacttaaacataacgcatcaccccactaatctaatctatttcgcctattgcccatttttttctaaattcccacaattcagtgccacttggcccaaattcgcgttaattgggcatttccccttataagggccttattcacattccgggtaaccggtttaccctagtgggcttaaataaaccgggtggtcccaattaaatttcttaacattgttccccttgggcttccttgggctttccc

SEQ ID NO: 443808 - DNA, 1312 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaaaaaaaaaattgggggggggccggggccccggaagaggttttatcaaaaccactcccgtgggcggccgcgggccccactatacggtacactgaccctggggccacacaccggtgtccccgagggagacccgggcgaaagaacagtggggcggtggtttccccacccaaaaaacaccccgcggggggcaaccgaggcggttttgaacaaatccagaaggggtccgagcgcacaagggggctcatcaccgggccagggaagcaataa

SEQ ID NO: 443809 - DNA, 1117 bp, Homo sapiens
  misc_feature (889)..(889): n is a, c, g, or t
  misc_feature (896)..(896): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagacactgttgtnggcgccnccgtgggcccctctcggaaagaacgcgttctcttatagacaaccacattcggtgtgtgcggcgcgcgcggggcgcccccagagagtgaaggcacagaggcgcacacatgttgcggctcaaaagacgcgtgtgtgtccctctatagggaagacacccggggggggcacagggacaaaagggcgcgggggcgaaattttctctcacaccaatgtataagaaaa

SEQ ID NO: 443810 - DNA, 948 bp, Homo sapiens
  misc_feature (53)..(53): n is a, c, g, or t
ggcgaccaactaaggctaggtacgagccgggtgttgaatcggccgaggcggcngagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443811 - DNA, 898 bp, Homo sapiens
ccgcccgggtcaggactggtttggacgcggccgtttcgttttgacgagggctcgtgtacattgaccttagtgacattgtttgaaacttaaattcgtaccatcaagacgtgtcagtttaattggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443812 - DNA, 1441 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaaggtaatcaccaagtttgtctgctttctttacctgtcagttttctcccatgatcagggctgagcagtaccagttccgaaggaaacatcatagggccattctgtggttttaacattaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctaggtcaggccagcatcctcttgtttttcttgaggttcctctccaaagaggctgtatgagcagcagtgccaaagcctggccgccctccccagaagagggcgctggttccttggcaccttgtgtggcttaggtaaccatgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443813 - DNA, 1610 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgtatcatttgaactgctgataacctgagaaggggctcaggcatggtttaaaatgttcgtatcttcactaagtacggttctttcctcacatgcagtttcttaattggatggcactgacctgtttcttttcttgctagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443814 - DNA, 1112 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443815 - DNA, 1012 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaaattttaattctgaagaattgagaatgatgttgtaaaaaaagaaaaaaaagaaaactgcgggcttctattgcgggggggcgacaaagtgttggaatggcttgtcttactgtgttcttgacgccttttttcaaagggaatgcgggtcccaagggggttaaatcgaaaacctgactgtgtttctgtcaccagcgcgaggtcaaaaaacgagacacgcagcgatgagaatggtaactggacagatgaagtgatgttcaggttgtgtcaca

SEQ ID NO: 443816 - DNA, 981 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443817 - DNA, 842 bp, Homo sapiens
  misc_feature (11)..(11): n is a, c, g, or t
  misc_feature (618)..(618): n is a, c, g, or t
  misc_feature (626)..(626): n is a, c, g, or t
aacatacttcncaatttcttcaggatttaaaatcttgagggattgatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaatttgtggggggcttgggccccggaaaaagtttttaaaccaattcggtggggggcgggggccccntgggtaangttgaacatggtgtcatatagctgtggttatctagaaggaagaatcggggtcctagaagtaagtgtcgtgggttgtttcacccaattaaaaaaaaggcgggggggaacccgagtgtttttggaaaaaatcccgaaatagagatcggagaggaaaaaagggcatctactacacaaggggattcaaggagacacgcatattcaaaataagcgcgtgtg

SEQ ID NO: 443818 - DNA, 1694 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcaggtgggtgcctgcccgcttgcatgctcacctctggcagcagggcagtcacggctccgccatggagggtcctgccatgtcacttcaggtgaatcagaaaactgatttattctggggcgtgatcctaatcttgacttgcacaagtgtaacttgacctagctcaccaatttcagtaacattgttctgttctcagttcctggcatgggatattccaaattcctgtgtctggagggaaatgatagcttttgtcttgccatcctgagtgaccagtcacaaagcagttgaagggggctggaagccaccctatgaggacacgccattagtatgtaagcagaatgtgtgtctacctgtcaaagtaatttccagtaacctgagttcacaattctggtcctaggtgagtttttctaggagtgaaaatgcagaaaaggatgttgaaagctattggctaatgtatcatttgaactgctgataacctgagaaggggctcaggcatggtttaaaatgttcgtatcttcactaagtacggttctttcctcacatgcagtttcttaattggatggcactgacctgtttcttttcttgctagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagattgggggcttttattttgggggggggaaaaaggagggtatgagaatgggcgccaaggggtcttgcgtggttcccgtggacccacgtttccttggtccaacggtgggtaagatcaggccgggtctcccatatagggaggtcggaataaattccgagataggcaggtaacctggttatgttcgtgcggcacaagcagggaaaacaatagaaggagggaaagggaagaacagagt

SEQ ID NO: 443819 - DNA, 1810 bp, Homo sapiens
gcctcttgatagcgcagtaaaacatacaatcgtataaccccattctcggtaagaatcagcatcaactctaaagagctctttgcaaaaggaagccacgaggcagggcctgtgtccacagctgctgtccagcactccagcttgcctcctgccactgccactggctgggcggcccatgtagggcagctgtgttccagggctggccctgggttgtcatgccctatgccacgtgagaacatacgtgtctgttttaggccaatgccataggccggggtgccaagtcagtgcgtgagttcctggagaagaactatactgacgaagccattgaaacagatgatctgaccattaagctggtgatcaaggcactcctggaagtaagtttgcatttggaatccaggcaaggtggtgaagataccacgttttggtggtgagtggtaggtagatgagcaggaaggaaggtggcaaggatccagcagtaatgcttaatgactgctgtgttccaggcactgctctggtctatggtgtatcctaactgctgtgttccttgaaatagccatgcaaggtgtgatcattagtgtctttatccagccggggcagctgagggttgtgcagggacacacagcatgagaaccagaggcaggatgtgaacccagctgtccagctgtggaatctgttctcgagccatcactaggccttccagaggcttgaactgttgctaaagtcaggggattagagaactggagatatggttgggctttgtcaagaccttgaagtgctagcaggtaaaaccagagagggactagctggaaggccaggcgggagcgtaggcatcaggattcctggttgtaaccactgtgtcaagaggagggcctggagcagcgctactgtgcaggagagaggagtcccagtgctgggaggcggaggggtgtgcaggcatcccaaacagacttcacaaatggccatgagtttaggacaaagacacaggttttgggggctgggacctctgttcctgggacggtgctgggtttgggtacacacctatttaaggtactcctgagagctgcttttgtcttgaatagggaaaggtggctaatgctcctgtcttctgtcccttcaaggtggttcagtcaggtggcaaaaacattgaacttgctgtcatgaggcgagatcaatccctcaaggtaatcaccaagtttgtctgctttctttacctgtcagttttctcccatgatcagggctgagcagtaccagttccgaaggaaacatcatagggccattctgtggttttaacattaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctaggtcaggccagcatcctcttgtttttcttgaggttcctctccaaagaggctgtatgagcagcagtgccaaagcctggccgccctccccagaagagggcgctggttccttggcaccttgtgtggcttaggtaaccatgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443820 - DNA, 512 bp, Homo sapiens
  misc_feature (27)..(27): n is a, c, g, or t
  misc_feature (86)..(86): n is a, c, g, or t
  misc_feature (102)..(102): n is a, c, g, or t
agcttcccccatagaaggattccatgngcagatcaggacacttagcaaatgtaaaaataaaatctaactctcatttgacaagcagngaaagaaaagtaaatnccagataagcttttgatttttgtattgtttgcatccccttgccctcaataaataaagttcttttttagttccaaaaaaaaaaaaaaaaaaaaaaaaaaaaaaaaaatggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443821 - DNA, 458 bp, Homo sapiens
gtaggcctttccattccatttattcacactgagtgtcctacaataaacttccgtatttttaaactgtttttttttttaagagaatgtgtatctttaggtgcaatcacagcagtcctctcatctctcacccttctttttcaaccctgagccaccgtaattgagctttcctttctgttccttgtggctaagacagtaagccagtgtgagacacaggttcctcccttgggaagtcagagctgctgccctgggtcctgcagagaaacctggccttcagcagacctgtttctctgttgtagacacagaatgacttccgtttgcttttagaccttcattctagtcccctaatgaatgtataatgtcaaggacacaaacacaagtagccctgggttcattctgtagagcagcagctttgttcaaagcagctttgcatgtctgactttcatagaccacatcttgac

SEQ ID NO: 443822 - DNA, 1027 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443823 - DNA, 1293 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaacaaaaaaagaaaatggataaacaataaaaaggataacctttacttaaagcataacatatttagtataattgcaaactttcatttatcaagcgcaaaaactctgtatactcctttttttattaaaaaaactatcaagtttaaatggggcccctcttttaccacattctttttttaccccttagcactttttttactggggccccatattagcctcttttgtgcaatattccccttagggggggttttc

SEQ ID NO: 443824 - DNA, 1351 bp, Homo sapiens
  misc_feature (1110)..(1110): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaaaaaaaaaaaaaaaaaaaaaaaaaaaaaaaaaaaaaaaaaaaaaaaaaaaaaaaaccaaaaaaaccaaaaaaaactacacacancaaaacttaaacataacgcatcaccccactaatctaatctatttcgcctattgcccatttttttctaaattcccacaattcagtgccacttggcccaaattcgcgttaattgggcatttccccttataagggccttattcacattccgggtaaccggtttaccctagtgggcttaaataaaccgggtggtcccaattaaatttcttaacattgttccccttgggcttccttgggctttccc

SEQ ID NO: 443825 - DNA, 1301 bp, Homo sapiens
  misc_feature (1077)..(1077): n is a, c, g, or t
  misc_feature (1085)..(1085): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccaaaaaaaaaaaaaaaaaaaaaaaaaaaaaaaatttgtggggggcttgggccccggaaaaagtttttaaaccaattcggtggggggcgggggccccntgggtaangttgaacatggtgtcatatagctgtggttatctagaaggaagaatcggggtcctagaagtaagtgtcgtgggttgtttcacccaattaaaaaaaaggcgggggggaacccgagtgtttttggaaaaaatcccgaaatagagatcggagaggaaaaaagggcatctactacacaaggggattcaaggagacacgcatattcaaaataagcgcgtgtg

SEQ ID NO: 443826 - DNA, 1394 bp, Homo sapiens
  misc_feature (1342)..(1342): n is a, c, g, or t
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagacccttttgtgcggcgcgcgcgcacttgggccctcggaaaaggtttctataaaaccacttccgcgttgggcgcggccggggggcgccccatgaggttaaacagtggcgaccactgtggcgccataagcgcgggtgccccaagagggagagcagacctccccgggggcgcacaaagcagacatcagagggcgcgtggggcgattctctctccacagcatatataaaaaaagagcgcgcccgcagaggggagggaaaacaccccgcgaagacgcggcgttgttctctgatgagagaacaaaaatctctcgccgagagcagtaccgaagagatatctccagaggagacggggccataccaaaactaacaggcggggggagaacctattataatcttacacgcagcaggggggcgaggtcctcccaacagcgcgagaagcctgcccggaaaatatttatctcaccaantattttaaggcgcccccgcgacagaggctcggtggggtgggagtgaggggca

SEQ ID NO: 443827 - DNA, 956 bp, Homo sapiens
  misc_feature (48)..(48): n is a, c, g, or t
agagagagagagagagagagagagagagagagagagagagagagaganactcgtgccgaatgagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443828 - DNA, 1174 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443829 - DNA, 964 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaaattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443830 - DNA, 2185 bp, Homo sapiens
gtcgccgcctgacgccgcccgtcgccggcagcgcaggacacggcgccgagggtggggcgcgggcgtagtggcgccgggagtcgcgggtgcgcgcaggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttggtgttcgaggaagagacattgttgttcttggtgtggagaagaagtcagtggccaaactgcaggatgaaagaacagtgcggaagatctgtgctttggatgacaacgtctgcatggcctttgcaggcctcaccgccgatgcaaggatagtcatcaacagggcccgggtggagtgccagagccaccggctgactgtggaggacccggtcactgtggagtacatcacccgctacatcgccagtctgaagcagcgttatacgcagagcaatgggcgcaggccgtttggcatctctgccctcatcgtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtaagtttgcatttggaatccaggcaaggtggtgaagataccacgttttggtggtgagtggtaggtagatgagcaggaaggaaggtggcaaggatccagcagtaatgcttaatgactgctgtgttccaggcactgctctggtctatggtgtatcctaactgctgtgttccttgaaatagccatgcaaggtgtgatcattagtgtctttatccagccggggcagctgagggttgtgcagggacacacagcatgagaaccagaggcaggatgtgaacccagctgtccagctgtggaatctgttctcgagccatcactaggccttccagaggcttgaactgttgctaaagtcaggggattagagaactggagatatggttgggctttgtcaagaccttgaagtgctagcaggtaaaaccagagagggactagctggaaggccaggcgggagcgtaggcatcaggattcctggttgtaaccactgtgtcaagaggagggcctggagcagcgctactgtgcaggagagaggagtcccagtgctgggaggcggaggggtgtgcaggcatcccaaacagacttcacaaatggccatgagtttaggacaaagacacaggttttgggggctgggacctctgttcctgggacggtgctgggtttgggtacacacctatttaaggtactcctgagagctgcttttgtcttgaatagggaaaggtggctaatgctcctgtcttctgtcccttcaaggtggttcagtcaggtggcaaaaacattgaacttgctgtcatgaggcgagatcaatccctcaaggtaatcaccaagtttgtctgctttctttacctgtcagttttctcccatgatcagggctgagcagtaccagttccgaaggaaacatcatagggccattctgtggttttaacattaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctaggtcaggccagcatcctcttgtttttcttgaggttcctctccaaagaggctgtatgagcagcagtgccaaagcctggccgccctccccagaagagggcgctggttccttggcaccttgtgtggcttaggtaaccatgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443831 - DNA, 597 bp, Homo sapiens
gcactcctaggctctatcagagtcgaaacccacgatgagggcagagatgccaaacggcctgcgcccattgctctgcgtataacgctgcttcagactggcgatgtagcgggtgatgtactccacagtgggtttcgactttgatggcactcctaggctctatcagactgacccctcgggcacataccatgcctggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443832 - DNA, 455 bp, Homo sapiens
agttctgacggagactctcgacttcccctcgaggcacataccatgccttggaaggccaatgccataggccggggtgccaagtcagtgcgtgagttcctggagaagaactatactgacgaagccattgaaacagatgatctgaccattaagctggtgatcaaggcactcctggaagtggttcagtcaggtggcaaaaacattgaacttgctgtcatgaggcgagatcaatccctcaagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaaa

SEQ ID NO: 443833 - DNA, 447 bp, Homo sapiens
taacttgctgaaggtcatacagctcttaactggtgtatctgggacttgaataatctgggttagtagcagattgaaattatttggcatatggactagtcagggttctccaggaacacaaaacctgtaggatggtgatattgagagatttgttccaaggagttggctcctgtgatgatggaggctgacaagtccctagatctgcagttggcaggctggagatccaggagagctgatggtggaagatggtgtaatttccagtcctagcctgaggcctgagaactggaactggtggaatagttcttgtctgaaggcctccaagctcgagacccaggaagagccaatatttcagatagagttggaaggtgggaaaaagccatcatcccccaaaggcagtgaggcaggagggattctccctcacttgggggtggatcagactcttgttctata

SEQ ID NO: 443834 - DNA, 382 bp, Homo sapiens
agacgcacatgtacacacacatgtgcacacacacgcacacctatacaccttctcttggagctgtacatcaggtaacataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactccaaggaaaatcgcttggacccaggaggcagaggttgtagggagcagagatcgcaccattgcactccagcctgggcaacagagcaagactccatctg

SEQ ID NO: 443835 - DNA, 4345 bp, Homo sapiens
  misc_feature (1562)..(1562): n is a, c, g, or t
  misc_feature (1667)..(1667): n is a, c, g, or t
  misc_feature (2071)..(2071): n is a, c, g, or t
  misc_feature (3399)..(3399): n is a, c, g, or t
  misc_feature (4345)..(4345): n is a, c, g, or t
agacgcacatgtacacacacatgtgcacacacacgcacacctatacaccttctcttggagctgtacatcaggtaacataggggcttttttccctctcactcacccctacctaatagtccccgtctcatttcatcaaatacaaatacaaatcctcatgggaaaaataaatgtattcagtgagctcatggaagggaggagagagcagaataaatcttggtctagttagcaagtatttccacacagaggctcccatcaggtcagctgaaaagtccagttagatgaactccaaggaacgctgaagacccacaaggaactgtccaggaactcactgaaagcaccttaaacagattgtaacaggaatgatgattgcagatacactgttgaacttaaaaatgggatagaggaactgcagacaacacaggtgttttaaaccgtaggctcggtagagaaagcagcgagtctccgcagatggccggcactgagagccagcaagaagcggaggagatgggccttcagcagggggttgcggggggagctttaaactgagccctgtaaacatggcagaactgctcagtgggagactctcagcacagacggtcatggggaagtgagtgcagttcatttgtaatcttgttgtcgagttctgggttttttttgtttgtttcgtaactttaaaggtatgcactttatatagatttatttatttgctgggaccgttactcagagttcctagaaatgtacacagcttttttaccagggttactcctcagaatcacttgtcacttctttaaatgaatgaatgaatgtgccaggccctatgcctggaggttgggagcttcatctacatcacattctaacaggtgaccactggggtaagcactgtgtgactgcaaagccagggtgtgtttccatcaacacccagatgaccgtgcctatgtgcccctgttgtcctccctccaggactgcctcctcaccccacccctttctgcagctcctcatctaaacatctcgcctggtgaggtcacggcttagcctgttggccagtggccccaccaccatccttccccctgtgcagattggaggaggccaggtctctccccttagctcctatgtccccttcaccccccatggcacagatgagacattcacagagtttgcagatgatggaagagaagactccaggttgccaggtgtgtccactctcaggaacccccagcccaagcctcactgctcgtgttcccagccaaccccagcacgggggatacgccggtgctgtttccctgctcagatacaaccagttaccagaaacgacctcacccctccaaccactttccaaggtgccaggacagagaagcccttcactggcccacccagggcagttgacagagggatgccctccttggaggggagcctcacctctacccacagggccgcggccttgtcctggattctcaccggggcagtcacgtcaggatggagaggtcccatgtcagccagttctttggtgggggtcatgtagtctgaaatgacctgccgatggtccaggctgagccagggaagcngagcctgggtgcctttttggtgcctactctgacttgagttggattcatgccacagacccaccttcttgagcaacaacacatatagccaccaacacaagagccagncacacactgagcagagaaagtccctgtcgcctcaccacccaaaaactccagctttgcagagaccaaggttcttctctacctttgcagaagcctctgtgaccaaacccggagcttgcccttctgaggcctctagcatttctccaggtgtttttcagaggacttggtttaaatttgttcaccccaaatgtggtctttcccggatcatgaaaggatctgccgcaaaggtgaatctgagtctcctcagagtcatatgagactgaaactgcttataacatttccgtgacctaataagtcttccaaaaatgtagggtattaagagtttagtgacattaaaaagtttagtcgaaaatatcgtgattcaggtatatttagacatttgattcatgccaaattgccactgttancagaaaacacaccccaagcacattaatgcctagatatttcaaacccttttctgcccacacattcttaaaaataatatactgagaaatctatatacaggtttttttttaattagcttggaaaagagcagttgtattctgtttgaacagctgctaatgtcaattcctgtgggaagaaagaccaaagaacatggagttacaccaagaattttaaaacaaagacgctgtccctttcctgagcaccgtgcagccaagactgagagatcagtctgagacctgtgattaaggagtgttttctacatagcgtataattatggagccacacaagtgggccattactctgttgagtgcttcatgtttgaggtattttcgtgttccaacttacattaaagtgtttataaaacaggaaaaatccacgagcaggtattgacactatccatattagatcatcacaaaattatatatatagcagagtcataaacaatgagaaacggtcttcccacacttgctttaaatggccatgacctagtgtttagggaaagcagtaaaatcagcgaggagctcgtgggaaaaatgagacgggccctgagggggtgactcatgggccaagcagggccacacaggtaccaggccgccacgtcctctcctgcctctcactctctggagactggacttcctttactgcctcctttctgacatttcctagacatcagactttgctacttagtacacaaacggggttcccttttaaatttgttcactctagttagcatttgcagaagctgtgaagaattacagagagatgatgtgttgggtaagagatggtttaaaagtccagcttgctgtttttcattaagtgtcttgaaaatgagtaagtggcgttcctggaggggaacaatcatataattccgcagggtgggtctaaacttgttttctgatagtgtttagcagctcatggctctgagggcacctgataacacagcagccaggcgctgatgagaagtgtgtgccagacagacccgagtgtggcttggctcttgccttatgttcctttctctgttcagagaagcgtgagatgagattttgtgattatattgtactccttgggctgactttcccatgcacagaatgttttacacatcctgatagctgagctgaaaatgcaaagagaagggaaaatgccttaaattgttctggctaatttagaagcagcaggccttggaagtctttgtcctgtgtccctgaacaaatcttatgggagctctggtacctatgccagaaaatgcacataggcacaacacttttacatacacgttcacacaccccacccntatggagaacttttttctaaataagagaaagaaaaattttaagacttacaagttatgtttaggtattttacatggttcagaaaacaagacatgaagcggtataaactgagaagtcttgttcccacaaccccacgtgccaggtacacataaccatttttattcacctctagcttgtgcttccaatgtttgttaggcatatgtaaataagtgaatagataagcatttctccctccttttgctgacatgagtggtggcatgttttgcccctggcttttatcccttgaccccattccagtacctagagacctgcttcatttttttagatgtgtaatacttcatgtgtgcgtgtgccttagtgattaactcgtgcactgtgcagggacatcgggctgggatcagtttgttcactgatatatacagcgctgcgggagataccctcacatgtgtatcatttggtccatgtgcaggtgtgtctggaagatagaattctaggcgtagaattgataggttaaatgtatttatagggaaaaaatcaatataaaactttgcgtgtaatgatatttgcgtgcttttttttttaatttttttacccaagaaaaaaaataataaagcagaaaaaagaagaaacaaatgtgtggggggggagacggacctccggggaaaaggctctctatcacacacaactctcgttgggagccccgggcgccccaggagggggcaatgacacacaggttggagcctgaagcggtgaccccgaagagagatccgtgcggcccagaaccacacgcggggagagatcacccacgaaagtaaaaaagagccccgcggggggcacacacagcgtgctgtgggtggaacaaccctgagaagcaggctgagagaggcaaacggggagctcgttccaagggaggccaaggagccggtttaaaccaggcgcggcgagggn

SEQ ID NO: 443836 - DNA, 948 bp, Homo sapiens
  misc_feature (9)..(9): n is a, c, g, or t
  misc_feature (11)..(11): n is a, c, g, or t
  misc_feature (16)..(16): n is a, c, g, or t
  misc_feature (23)..(23): n is a, c, g, or t
  misc_feature (25)..(25): n is a, c, g, or t
  misc_feature (948)..(948): n is a, c, g, or t
cctcgacantntcggncagagtngngaggaaagaaaaattttaagacttacaagttatgtttaggtattttacatggttcagaaaacaagacatgaagcggtataaactgagaagtcttgttcccacaaccccacgtgccaggtacacataaccatttttattcacctctagcttgtgcttccaatgtttgttaggcatatgtaaataagtgaatagataagcatttctccctccttttgctgacatgagtggtggcatgttttgcccctggcttttatcccttgaccccattccagtacctagagacctgcttcatttttttagatgtgtaatacttcatgtgtgcgtgtgccttagtgattaactcgtgcactgtgcagggacatcgggctgggatcagtttgttcactgatatatacagcgctgcgggagataccctcacatgtgtatcatttggtccatgtgcaggtgtgtctggaagatagaattctaggcgtagaattgataggttaaatgtatttatagggaaaaaatcaatataaaactttgcgtgtaatgatatttgcgtgcttttttttttaatttttttacccaagaaaaaaaataataaagcagaaaaaagaagaaacaaatgtgtggggggggagacggacctccggggaaaaggctctctatcacacacaactctcgttgggagccccgggcgccccaggagggggcaatgacacacaggttggagcctgaagcggtgaccccgaagagagatccgtgcggcccagaaccacacgcggggagagatcacccacgaaagtaaaaaagagccccgcggggggcacacacagcgtgctgtgggtggaacaaccctgagaagcaggctgagagaggcaaacggggagctcgttccaagggaggccaaggagccggtttaaaccaggcgcggcgagggn

SEQ ID NO: 443837 - DNA, 270 bp, Homo sapiens
  misc_feature (42)..(42): n is a, c, g, or t
ggatccgcccccctcggcctcccaaagtgctgggattacagntgtgagctaccacacccggctttttttttattctgtgtagagaaagggtttcaccatgttgcccatgttggtcttgaactcctggccccatgtgatccacccacctcggcctcccaaagtgctgggattacaggcattgagccaccgtgcccagccagctcacacctgaagctcttaagtggaaagcctctttgcttctctgctcttgtcttcctcttccttggttta

SEQ ID NO: 443838 - DNA, 2060 bp, Homo sapiens
tcctttaaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttg

SEQ ID NO: 443839 - DNA, 882 bp, Homo sapiens
ttatagaggaagatgtgtggagtgtatttccattttgaacgagctctatcagaacaaagattcgtttattcttaagattttacgtcagtgttcgatttgttagtattgtagtcgcaagggtatttaatgttcgctgtaaggtgaactcggaggtttgagaaggtttacgtatctgccccagcggaggtcgaagttaacctcggtcccttccccagtgcttcccgttccggattaaaaagcgcaaggcccgcctcgctcttcctgcagcaatttgcaaacgggtacgctctcggaagctgctacgggttcggtcaccttcctcttcggcgtctggcccggcgctcgcggacaggcgcccgcgttgggggccgggggattgaggtgtccggtcctcccgggacacattcacacacaagcgcagccgccagaaagctgccgaggaccaggccggcgcccagggtcgtgggcgccagtgcggatttcgattctgagattcaccctttcttccccgccctaacgctgtgcttctctggcgccctcccggcgcccgggctgctttgggccgctaggcactcagcttccagccgggttcgtcggcctcagggcggaaagagatggccacagccgcgcgcccgcagcctggtacctgtccttccagtcccgcgcctcggggtttggccgtccagaggccgggggcttgggggcttggggcttggaccttcgtgcggcctgtgtttcctcctcctcctcctcctcccgccgctcagcttttatccctgcctgctctctgcagggagtcctgagctggggccaggagccccgggccgcggcgagctcactttcagcagcagggctggcacctggagaagaacagcctctccc

SEQ ID NO: 443840 - DNA, 1990 bp, Homo sapiens
aacaagtattagagtcgactccgggtggtatttcgtcacaggcttgccgttgcatgagttcctttggcctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 443841 - DNA, 1902 bp, Homo sapiens
cgcacgctgcagccgagaccccttctgtcacctcaaaatggaagatcgcattgcgagagctgtgacagggcttgctggggaagtgttgggagacgaaggagggagcgaggagaaagagaaataaaagggatgagggagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 443842 - DNA, 1510 bp, Homo sapiens
actacatacttccggagactacatacttcggactacatacttccggactacatacttccgactacatacttctgactacatacttccgactacatacatctgactacatacttccgactacatacttctgactacatacttccgactacatacttctcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 443843 - DNA, 1279 bp, Homo sapiens
  misc_feature (1205)..(1205): n is a, c, g, or t
  misc_feature (1268)..(1268): n is a, c, g, or t
  misc_feature (1273)..(1273): n is a, c, g, or t
tcctttaaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtattcaaaattaacagntcatgctgaaaaccactcaaacgattatattttttacattataagaagtaaaatatattattnaaaantaatga

SEQ ID NO: 443844 - DNA, 1250 bp, Homo sapiens
tcctttaaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacgtaagtgtcctctctggccggctggacttcggttttgggggcgctactgaggtcggagagtgccgagcctccccgcctgcgctcagcgttcagcgccagcgcgaatccgcatcggctcactcttgccttctggctccaacccccaggcctaggaccaggcccccgggttagaacctgcgcttcccaaggggatcccacagcccggggtgggatatggaggaggatccttcaatatagacccagtcccagctctacgcggcctctcaggcttgcacagaggtgcgcatgctcgacatgctgggagccagggcaaggggcatgaaggattgctacgctcttgcgtgaacgagtgacctgccaggtgttctctgaagaacagttagtttggatttg

SEQ ID NO: 443845 - DNA, 1209 bp, Homo sapiens
  misc_feature (1135)..(1135): n is a, c, g, or t
  misc_feature (1198)..(1198): n is a, c, g, or t
  misc_feature (1203)..(1203): n is a, c, g, or t
ttatagaggaagatgtgtggagtgtatttccattttgaacgagctctatcagaacaaagattcgtttattcttaagattttacgtcagtgttcgatttgttagtattgtagtcgcaagggtatttaatgttcgctgtaaggtgaactcggaggtttgagaaggtttacgtatctgccccagcggaggtcgaagttaacctcggtcccttccccagtgcttcccgttccggattaaaaagcgcaaggcccgcctcgctcttcctgcagcaatttgcaaacgggtacgctctcggaagctgctacgggttcggtcaccttcctcttcggcgtctggcccggcgctcgcggacaggcgcccgcgttgggggccgggggattgaggtgtccggtcctcccgggacacattcacacacaagcgcagccgccagaaagctgccgaggaccaggccggcgcccagggtcgtgggcgccagtgcggatttcgattctgagattcaccctttcttccccgccctaacgctgtgcttctctggcgccctcccggcgcccgggctgctttgggccgctaggcactcagcttccagccgggttcgtcggcctcagggcggaaagagatggccacagccgcgcgcccgcagcctgcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtattcaaaattaacagntcatgctgaaaaccactcaaacgattatattttttacattataagaagtaaaatatattattnaaaantaatga

SEQ ID NO: 443846 - DNA, 2476 bp, Homo sapiens
tcctttaaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 443847 - DNA, 2406 bp, Homo sapiens
ttatagaggaagatgtgtggagtgtatttccattttgaacgagctctatcagaacaaagattcgtttattcttaagattttacgtcagtgttcgatttgttagtattgtagtcgcaagggtatttaatgttcgctgtaaggtgaactcggaggtttgagaaggtttacgtatctgccccagcggaggtcgaagttaacctcggtcccttccccagtgcttcccgttccggattaaaaagcgcaaggcccgcctcgctcttcctgcagcaatttgcaaacgggtacgctctcggaagctgctacgggttcggtcaccttcctcttcggcgtctggcccggcgctcgcggacaggcgcccgcgttgggggccgggggattgaggtgtccggtcctcccgggacacattcacacacaagcgcagccgccagaaagctgccgaggaccaggccggcgcccagggtcgtgggcgccagtgcggatttcgattctgagattcaccctttcttccccgccctaacgctgtgcttctctggcgccctcccggcgcccgggctgctttgggccgctaggcactcagcttccagccgggttcgtcggcctcagggcggaaagagatggccacagccgcgcgcccgcagcctgcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaatgggggtgtcgtttgtttcctaccccaacctgctttcttgacccagttctcagggaacctgaagggacacaggatgccggtgataagctcacctcttcaggaagccgcttcaagcagacctgccaccttcaagcagaccctcctcacttaagccacttggccacttccccgaaaccgtgcttccttaaaaaagagaaaatgaaagttgtttttaaattaattacaaagcagagattctttctgtttgagatttagaggaactgggcttgctcgcacaggcagacaatgccagtggccggccgtctgcccccgcctcaggcgggccggagccctaaccacgatcctcgcaggctcggcctaaccacgattcgcctcttcctgtgcggtggccagaggcagcttgcgaaggaacc

SEQ ID NO: 443848 - DNA, 952 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggata

SEQ ID NO: 443849 - DNA, 797 bp, Homo sapiens
gatcacggttactgtgacctgactggagaaaaattatgtgtctgcaatgatatttcggcaggtcctgacactccggtgaaagtcacctccacggagtcgtactggattccgccacacgttaaacccttcagtccttctgtaggtcgggcttcacataaagcagttttacacgggaaatttatgtgggtgattggtggatatacttttaactacagttcttttcaaatggtcctaaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggctt

SEQ ID NO: 443850 - DNA, 324 bp, Homo sapiens
ctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtg

SEQ ID NO: 443851 - DNA, 1033 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccgggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggctt

SEQ ID NO: 443852 - DNA, 682 bp, Homo sapiens
agcggagttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttc

SEQ ID NO: 443853 - DNA, 2437 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttatta

SEQ ID NO: 443854 - DNA, 3557 bp, Homo sapiens
gaaacttcatggagaagtactgccggctcttggacttttcttccagaagtggcacatttcacttctcatattttaattgtggaaagaaatcacatggccacacttgtctttgtttgtttgtttgtctgtttgtttgagacagcgtctcactccatcaccaaggtctggagtgcagtggcatgatcacggctcactgcagcctccacctcagctctaccaagtagctggaactacaggtgcacatcaccacgcccagctaatttttttgatttttgatagagacaaagtctcactatgttataacccaggctggtttcaaacttctgagcttggcgatcctcccatctcagcctcccaaagtgctgggattacaggcatgagccactgtgcccggccacaagatttatatttctatatgcaaattatatttagagtttttagaaaatgcctagctataatcatggatcaaaataacaactgagagctgtgcacagtggcacatccctgtagccaggagttcaagtccagcctgggcaacataaaaccttgtctcttaagaaaagaattaataggaaaacttgaaattctatgcatttaaaaattattaaatgaaaataacaaaagattgttgtcagccactccaggactgggatataaggaccttagaaaatgctgtggtaaattctgcccccattgttttattttaataatagcggaaaatgggggtataccagctttgtaaggtaactttgttttgacagatttgtactaggactgactgtcaaaattttaaactttataattttcccagcttatatacagatctgtttataatagaatttttaagtacttggaaggaaagaaattacaaatagaacctttgtatttatgtttggagggttttttttcttattaactcttatagccagaatatataaactacacgtattttagcacactaatgaactgtttgagagttaaccatttttcactttatctttaggcttgtgtagtaaaacgtgaatttaagaaggcagaacagttaattaaacatgcagtgtatttggcacggtaggtgattattattaaaaatatccttttaaattgtctctatactttatatcctaataattttgtgtctttttatagggatcattttggatccaaacacccaaaatattctgatacactgctagattatgggttctacttactcaatgtagataatatctgtcagtctgttgcaatttatcaggtatgttaatggttaccctttttttctttcaacctgtattgacttgctgacctgtatttgtttgtggtgtataaaccactctaaaaatgactttttgacaactaccccgcccaccaatataggttgcatcattattttattaagtattacctagaaggtgtaaaagttaatgctttgggaattaaagaaaatcattcaggaaaggaattattgggttgtgagctcatatgtgggagtagttttccattttttatttacccatgtaatggcttgtctttgttgttgatttagcaaatgtcactaaaactgcctttgtagtaacaaagatggctgataattattttaggtctttcttactcattctcaggtaaatgatgtattatgccattgctgtagacaaggcatacttgacttcaaggttcacttttttttttgagacacagttttgatctgtcgcccaggctggagtgcaatggcgcaatctcagctcactgcaacctctgcctcccaagttcaagcaattctcgtgcctcggcctcctgagtatctgggattacaggcccgtgccacaatgcccggctaatttttgtatttttagtagagaggcggtttcagcatgttgcccaggctagtcttgaactactgacctcaggtgatccacccacctttgcctcccagaagtactaggattacaggtgtgagccaccgcgcctggcctaaggttcacttttgaagaaggaaacagagcaaaacattcccaatgtcttgattctcaagacataggaatgattattattattattattattaagccgtggccttttaagtcaaactcgtatcttcagaaattcaggacttctaggtgactttcatgttctgtaatttaaatacagcaggactttctgggcttcaaaattttatggtgttaggcatatagatatatatttaaattactaggatgtttaatttaactaggtggtattttctacagtattgacaaatatttttatgattctttcaggcagcccttgacattagacagtcagtgtttggtggcaaaaatatccacgtagcaacagctcatgaagatttggcctactcttcttatgtccaccagtatagctctgggaaatttgacaatgcactgtaagttccacattccttttctctgaaggaggaaatactgtttttgttttattttgttttttcccattagggaactattattacattaataatagtacttgatatactttatggattgaacttgtcttcctggagctttatcagaatgcctaaaatgttcttgaagtcatttaaaatcataccagttttcaggtgcagaggctcccgcctgtaatcccagcactttgggaggctgaggtggaaagattgcttgagcccaagagtttgagaccctgtctactcaaaaaatttttaaaactagatggacgttttggtgcatgcctgtggtcccagcttctctggaggctgaggcaggagaatcgcttgagcccaagaggtcaaggatgcagcgaagcatattcacaccactgcattccagcctgggcaacagagtgagaccctgtttccaaaaataaataaagtcatactaatttataggttattcatttagcctttatgtgatttactattgagacttgtatattttcatgcagaatataacttatgttttgagtatttccttcaataatttttgagtaatacagtagcaaacttaataacctaaaaacttcttggtgataacacatagaaatactgaataacaattgtctttttaaatatataactgagcttgcaagagtgagggggaaatcccccaagggccaataatggacactaaaatttaaaggattaagtatggcctgtggtataactgctctggggtgatgggaaagtttacagatttctgtaaccttggtttaagaaacagcctataggaggctgggagttagaactgaaaccctcacatgaagcaaagtcaagactgcaacccggccgggcgtggtggctcacgcctgtaatctcagcactttggcgggccaaggcaggtggatcacctgaggtcaggagttcaagacaagcctggccaagacgatgaaatgccatctctactaaaaatacaaaaattagccgggcatggtggtgggcacttgtaatcccagctattcgggaggctgaggcagacaattgcttgaacccaagaggtggaggttgcagtgagccgagatcacgccactgctctccagcctaggcaacagagtgagactctgtctccaaa

SEQ ID NO: 443855 - DNA, 555 bp, Homo sapiens
ccctcacggattacctcaactcttaacttcccgatcttgatcttgatggcaaccaaggtaacacaatatgaaatttttacttttaaaagtcgacattaataagagttaaaaaactaaacatgcgaccaggtgtggtggctcacacctgtaatcccagcactttgggaggccaaggtgggtggatcacctgaggtcaggagttgaagaccagcctggccaacatgctgaaatcttgtctctactaaaaatacaaaaattagctgggcgtggtagctcatgcctgtaatcccagctactcgggaggctgaggcaggagaatcacttgaacccgggaggcggaggttgcaagtgatgctgagaaagtttttctgtcctgccttcagttgtgtactctacacgatgagatgcttcattggtttcgtgcagtagaatgttgtgtgaggtaagttggaacatatcctgtaattacgtgctataacagtatttagtggcttttatagttttagctcttataagtatatgccaacatttgagtaaatctctgagatgatattt

SEQ ID NO: 443856 - DNA, 7625 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacggtaggtgattattattaaaaatatccttttaaattgtctctatactttatatcctaataattttgtgtctttttatagggatcattttggatccaaacacccaaaatattctgatacactgctagattatgggttctacttactcaatgtagataatatctgtcagtctgttgcaatttatcaggtatgttaatggttaccctttttttctttcaacctgtattgacttgctgacctgtatttgtttgtggtgtataaaccactctaaaaatgactttttgacaactaccccgcccaccaatataggttgcatcattattttattaagtattacctagaaggtgtaaaagttaatgctttgggaattaaagaaaatcattcaggaaaggaattattgggttgtgagctcatatgtgggagtagttttccattttttatttacccatgtaatggcttgtctttgttgttgatttagcaaatgtcactaaaactgcctttgtagtaacaaagatggctgataattattttaggtctttcttactcattctcaggtaaatgatgtattatgccattgctgtagacaaggcatacttgacttcaaggttcacttttttttttgagacacagttttgatctgtcgcccaggctggagtgcaatggcgcaatctcagctcactgcaacctctgcctcccaagttcaagcaattctcgtgcctcggcctcctgagtatctgggattacaggcccgtgccacaatgcccggctaatttttgtatttttagtagagaggcggtttcagcatgttgcccaggctagtcttgaactactgacctcaggtgatccacccacctttgcctcccagaagtactaggattacaggtgtgagccaccgcgcctggcctaaggttcacttttgaagaaggaaacagagcaaaacattcccaatgtcttgattctcaagacataggaatgattattattattattattattaagccgtggccttttaagtcaaactcgtatcttcagaaattcaggacttctaggtgactttcatgttctgtaatttaaatacagcaggactttctgggcttcaaaattttatggtgttaggcatatagatatatatttaaattactaggatgtttaatttaactaggtggtattttctacagtattgacaaatatttttatgattctttcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443857 - DNA, 6472 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagacttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443858 - DNA, 6472 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcattttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443859 - DNA, 5730 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443860 - DNA, 2741 bp, Homo sapiens
  misc_feature (28)..(28): n is a, c, g, or t
  misc_feature (92)..(92): n is a, c, g, or t
ccggaatttaaatacgacctcacctatngggaatttgggcccctcgaggcccaagaattcgggcaccgaggcctcgcctcgaagcgaaaagnccctaatagtagaagaacccctcccataaaccccggagtgacctatatggatgccccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443861 - DNA, 733 bp, Homo sapiens
  misc_feature (710)..(710): n is a, c, g, or t
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttagtggcttctttctgcngctggttgtgcggtttttctgtc

SEQ ID NO: 443862 - DNA, 6526 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443863 - DNA, 874 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaacggcaattcttcggtggtctgtgggcacaatatactctcgcgtctcgcgcgcagagatatgcgcctttgttgcgcccgagaatcactcgcagtgttggattgtcttactacaatgctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtaagtaatggtggaacagaagtattttgtcctgtgatggactcagaattaaatctgctaacaaagaattcttccagggctttcccaaagtctacgtaagaaggttatgagaagaacatcagaaccacttaaccccatgccaaagcattatacta

SEQ ID NO: 443864 - DNA, 6468 bp, Homo sapiens
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagaacagttaattaaacatgcagtgtatttggcacgggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagtgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443865 - DNA, 6529 bp, Homo sapiens
gaaacttcatggagaagtactgccggctcttggacttttcttccagaagtggcacatttcacttctcatattttaattgtggaaagaaatcacatggccacacttgtctttgtttgtttgtttgtctgtttgtttgagacagcgtctcactccatcaccaaggtctggagtgcagtggcatgatcacggctcactgcagcctccacctcagctctaccaagtagctggaactacaggtgcacatcaccacgcccagctaatttttttgatttttgatagagacaaagtctcactatgttataacccaggctggtttcaaacttctgagcttggcgatcctcccatctcagcctcccaaagtgctgggattacaggcatgagccactgtgcccggccacaagatttatatttctatatgcaaattatatttagagtttttagaaaatgcctagctataatcatggatcaaaataacaactgagagctgtgcacagtggcacatccctgtagccaggagttcaagtccagcctgggcaacataaaaccttgtctcttaagaaaagaattaataggaaaacttgaaattctatgcatttaaaaattattaaatgaaaataacaaaagattgttgtcagccactccaggactgggatataaggaccttagaaaatgctgtggtaaattctgcccccattgttttattttaataatagcggaaaatgggggtataccagctttgtaaggtaactttgttttgacagatttgtactaggactgactgtcaaaattttaaactttataattttcccagcttatatacagatctgtttataatagaatttttaagtacttggaaggaaagaaattacaaatagaacctttgtatttatgtttggagggttttttttcttattaactcttatagccagaatatataaactacacgtattttagcacactaatgaactgtttgagagttaaccatttttcactttatctttaggcttgtgtagtaaaacgtgaatttaagaaggcagaacagttaattaaacatgcagtgtatttggcacggtaggtgattattattaaaaatatccttttaaattgtctctatactttatatcctaataattttgtgtctttttatagggatcattttggatccaaacacccaaaatattctgatacactgctagattatgggttctacttactcaatgtagataatatctgtcagtctgttgcaatttatcaggcagcccttgacattagacagtcagtgtttggtggcaaaaatatccacgtagcaacagctcatgaagatttggcctactcttcttatgtccaccagtatagctctgggaaatttgacaatgcactatttcatgcagaaagagctattggtatcattacccacatcctacctgaagatcatcttcttttggcttcttcaaagagggtgaaagcacttattttagaggagattgcaattgattgtcataataaggaaactgaacagaggctgcttcaagaagctcatgatttgcacctgtcttcactccaactagctaaaaaagcttttggggaatttaatgtacagactgcaaaacactatggaaaccttggaagactttatcagtcaatgagaaaatttaaggaagctgaagaaatgcacatcaaagcaattcagattaaagaacaacttcttggtcaagaagattatgaagtagccctttcagtgggacatctggcttctttatataattatgacatgaatcagtatgaaaatgctgagaaactttatttgcgatctatagcaattgggaagaaactttttggtgagggctacagtggactagaatatgattatcgaggtctcattaaactttacaactccattggaaattacgagaaagtgtttgaatatcacaatgttctgtctaactggaaccggttgcgagatcggcaatattcagtgacagatgctcttgaagatgtcagcaccagcccccagtccactgaagaagtggtgcagtccttcctgatttctcagaatgtcgagggaccgagctgctgagggaggacctcagttaaccaattaccttttcccggattccagggaattcatactgtgaaatcaaaaccatgttgttttggggggctggaatttgcattgaaacactggtccagtccattgaagaccctattttgggtgatccctatcttgcagaatgtctgtaggaataagcatatattcagttatattcagcatgtaccgcatgtgtaagtagtctggcccacattttcaacctagtagaacaaacaacaggaaatcttttttttgttgtttttaaaaaattcattttgcagaaagcctgaaagaaaaaaaatacccctaaataaaactatttaagagtttaaaagagttgcattcttattatgtaaggatgattttaacaactttttaatatgtaattcttccatgtggaggtattcaatactgtagtgtaaagaaattttatgcggaaaatctttatatgcagtatagaaaagttaacacaagtactaataaaagagggacatcccgacttacgtttttctaccttgcccagataagtggatacaaccactctatattacaaggaaaggactgtcagattcatctgaactggaccagtgttgatctgtaatgtaatagaaaatctgatagaccagcacttctgacttttttttttttggtacaacaatgcaagatgctctgatagcatttgctaacaggaccaggaggatctaaaaaggaccagcctaatgtagaaggtggttatttggaccagaggctttagattattattttagatcctacatatacttttatcagtagaatgatttcatttagatgtataatgaaaaaggataatgcaaaaattatgtaatagataccaaattagggaagtttggcaatttcaatggcatatttttagtcaaggtacacagatggcagtgccataagcaagtctataaatatcggctgcagccatccccctcattttaaatgttgccctaataatcaatgcagttaacaagtatattggctgtgtgtcatgaaatagttcatgttcagatggaaatgttaggttactgtatggtttatggagattaatgaaaatgaatgcccaaaaataagtcttagaaaatcctccatttttatggtaaatagtaatacaactaggtcatttcatttgaaatctaggagtcaaatggaaagatcccctaataatacacctatttcactaacttgtctttctgtttattgggttttgatttgattttttgtaagccagtcaggttatttaatgatgaggtaataatcaaatttaagaatttgtgacatgtagcaattcaagaaacaaaaaggtattttgctgttacctcaattcttactgtagtagcccatctgatgcttctatagttaagaatctgggttccccccctattttcaggggttcatgacttggctgttaaagatgttgctcctagctaatgcttggagtagtctgtgggtgaatggatgtgtgttgaattttagttttcttttaacatgcatgttgggtgagaggggaaaaaaatctaagctgtctgccacattgagtacagaaaagttgtagatttcaaattttattaatattttaagcacttttttgaacttcccaaccttgtttgaagctgttatttgcagtcctattagttttgagccattgcatttaagttccctaggagggggttggttgggggatgtactgaaagagatgaagcaaacccacaccctaagatggtaactgtgtgatttagaaacctgagtttactcctcaaatcgaattattttctttttaaattttggaaagagtaaattgacgtacttgcagtttatgaagctgccccccacccctcagttaattgcagtctaatgtcaagaggcacttctttattaattaccaaatagtctttgtgaccaaggactaacatttttaagttactcagctctatcctcatgggcctatatatttaatacctccaaagatattttcaggataggctttgtatacttttattggttatttagaatccagtggtatgtttgtggtataggaatgtcatggtaaattgtttttcaataaatattttgaaacatgtttccatatgaagtttttttttcaatctgtattttttggttttgtgcacatacagcatttcctaggataaaaataaacaaatgacttacagcctcatcctccctaactccatttgaactcaacttagctcacactcagtgataaaacaacatggtatgtagaagcctaggatcacagggtgataatgtcaattggcagccagttgtgtttttttgaaacatcattattggcagtttctccttatcaccactgctttaatgtagtttttttgtaaatccatatactttaatgcatacactctagcttaagaaaacattgccattttggttagggatatgacttaatgtgctattatttctggttctaatgaagaataataccctatgactttaagtgtaagattcatcctttaagtagggatgtttaggataagttagatgtgtgccactatgatttattgggtttcttaaaaatcttgaagaaaataataaaatttatctcacaataagttaacttgcgcaaactttttacatatggtgaggtgcgtaaggaagccctggccaacttaaagatttttctggaggttcagcaaagttatgttaaattaggggcctttggtctcatccttctctgactcttctacccagtcttttcctaaagttcggtgctactccagttgggtgcatcagggagctccgtcagcactcgcatgtgtcgctcaggtggccactcatgcctgcattccatttaatagagtcaattggaatttttagagcataatctttatggatcctcaaagctgactttgccaaagggattgagacccttactaccatcaaatctctgtctctgcttggttaaaaattggctcactattgctttgtagtaacccctgcccaggtattttttcacttgtgaaaataatttgagaaagacctttgttcctagcctgttgggaaaagtttataattttatgaaaattaagtacagaggctgcgatcttagaaataatgaaggtgccatttggctgctccttaatagtgcagacagaaaactgcagtgaacacatgccaaaacatgattgaagcctttggctgaaactttatacatagaaataatgatttgctcataacaggtatcattaactgccactttttatgttttccctagaatttgtagccttgctgcttgcttttcttctgggtggcaaagttactactggaaaaacactataagtacaaagtttttggggttttatctttgctttagaagtggatgtgtacttcacctcttggctgtggaggaacttagttgccaggaaattttttttttttttttcaaacggagtttcgctcttgtggcccaggctgggagggcaatggcaccgtcttgggctcactgcaacctccgcctcccggggttccagcgattctcctgcctcagccttccgagtagctgggattacaggctcctgccaccacgcctggctaggaaattttttgtggttaatatgacatttggattaatctccagcttcaacagtacttcttttgtccataaatctcaggaatgttttaggcagaaaactggttttaccctgttgataatcagaaggagtgtgctttaggatttattgcataatactattctttaattgcaatcctaggtatctatagcatgagtggccttagtgagtttgttgaagtgcacatgtttttcaagagtaaaatttaagattaaaaatatatcctatatatagatatctagaaaacttggtttgtggtgcacagttaagtgttggatcactaaataaccattgcaggtaccgtttgtgtaacattactcatttctgtatattccttttatgggaagatattttgccatggtaactaaaacttttcagttctacttttatgatgtgaatgaatgctacgttttattaaatattaccaggtcagtactatttttatactttattaagcaacaggggattttagtttaataggctcaaaataaaaagttcttaatggaacagttaaaaacaaaacactaacaatctttacgtgaaaatccccactaatagtgccacaataatttctatagaaatatctaaggtcattaaatagatttttgaagacggttcttcattgtgtcaggatgacctttcatatcattctcaccaacttgtagtgcccaccgttatttgtaactattaaaccatactaagtatgtttgtaaccagcattgtgatatattctgtacttgtattgctaaaaatgaattattgacctaataaatatagtgttcctgcattcatagtgaaaaaaaatccaatttgg

SEQ ID NO: 443866 - DNA, 1437 bp, Homo sapiens
  misc_feature (1129)..(1129): n is a, c, g, or t
acgccgcacacgcagccccgcccctgcagagatcagcgctgggacggaacccgggttcctctcgaaccgggattgtgacgcttttggcctggctggccgctgttttctgtcccactttttactcgggcctgcgtccgctgccgccgtccctcagtttgcccccggaggaggcagggcggccgtgccttctgccgtgcgcccgcgtggctgccaccgcccctccgaatcctccggggccgcagaggggttcgctacggagggaggtgggggccttcgggaggaggaggcggaggaggcggaggaggagggaaggaagatggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaagacatttgcttcatcattgttttcaggctttgatggatcatggtgttaaagttgcttcagtcttggcctactcattcagtaggcggtgctcttatatagcagaatcagatgctgcagtaaaggaaaaagccattcaggttggctttgttttaggtggctttctttcagatgcaggctggtacagtgatgctgagaaagtttttctgtcctgccttcagttgtgtactctacacgatgagatgcttcattggtttcgtgcagtagaatgttgtgtgaggttgcttcatgtgcgaaatggaaactgcaaatatcatttgggtgaagaaacatttaaattagctcagacatatatggataaactatcaaaacatggccagcaagcaaataaagctgcactctatggagaactgtgtgcactcctatttgcaaaaagtcactatgatgaggcatacaaatggtgcatcgaggcaatgaaagaaattacagcaggcttaccagtgaaagttgtggtggatgtcttaagacaagcttctaaggcttgtgtagtaaaacgtgaatttaagaaggcagagaaaaagaaacgaggnccaaagccttcaacacagaaacgtaaaatggatggcgcccctgatggtcgaggaagaaaaaagaagctgaaactatgaatatgtttttgtttcataatcactaactttaaaccagtagttctttaatttacgggtcttcataaaatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcttttttta

SEQ ID NO: 443867 - DNA, 3529 bp, Homo sapiens
  misc_feature (2)..(3): n is a, c, g, or t
  misc_feature (5)..(5): n is a, c, g, or t
  misc_feature (8)..(9): n is a, c, g, or t
gnnanganncagaattgttgggcttcatcttggctctgtgctgcctggaggggagacctaggataggctcctgatctgcaaaatggggataatcccagctgccacttaagtgagacaagtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattct

SEQ ID NO: 443868 - DNA, 310 bp, Homo sapiens
gcggccgcccccggggagcccggcgggcgccggcgcgccccccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattct

SEQ ID NO: 443869 - DNA, 443 bp, Homo sapiens
atccgttctcttttaacgattatttgaaaagatgtcctttcatgtacttttggtgtcattgtgttaaccctctcaacctccaccaccacccatgtcaccaaaactgtgaaaggagggttttctgagagcctagacatggaggagaaggactacagtgaggccgatggcctttcggagaggaccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattct

SEQ ID NO: 443870 - DNA, 412 bp, Homo sapiens
tcctgggctcaggtgatctcccgcctgagcctcctgagtatctgggactacagatgcgtgcccccaagcctggctaattttgtctcatgtcttctaaaaattattttgtgaagcccccttccaaaaaaccttagtacctcccccccccccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattct

SEQ ID NO: 443871 - DNA, 464 bp, Homo sapiens
gaatctcagactccaggatttgagaatttgatgggtctagttttctgaagattctagtattcttgaattcttaatggctgaaagcatcttggcttcgaaacgtcaccttcacagagccctttaccccaccccgccctcacccctccagagcccactgtccttacctgacaccctgggtggggggtggttatattctgcagatcatcgggaaagatgtcctcaccagcacctacggcgccggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattct

SEQ ID NO: 443872 - DNA, 339 bp, Homo sapiens
cgagtgggtccctgcttgctgatccccctctgctggaaggtggacagcgaggccaggatggagccgccgttccccacggtagttcttgcgctccggcggagccatgatcttcatcttcattactggtggatgatagatatcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctgacatcttaatctgggcccagcctgctggtccggctcacttt

SEQ ID NO: 443873 - DNA, 5970 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443874 - DNA, 6124 bp, Homo sapiens
ccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443875 - DNA, 5981 bp, Homo sapiens
  misc_feature (2)..(3): n is a, c, g, or t
  misc_feature (5)..(5): n is a, c, g, or t
  misc_feature (8)..(9): n is a, c, g, or t
gnnanganncagaattgttgggcttcatcttggctctgtgctgcctggaggggagacctaggataggctcctgatctgcaaaatggggataatcccagctgccacttaagtgagacaagtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443876 - DNA, 6260 bp, Homo sapiens
ccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443877 - DNA, 5916 bp, Homo sapiens
gggtcgacccacgcgtccgctttcagatgctatcttgggctcgctgaacacgggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443878 - DNA, 5917 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaatcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443879 - DNA, 5717 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443880 - DNA, 2959 bp, Homo sapiens
  misc_feature (17)..(18): n is a, c, g, or t
  misc_feature (20)..(22): n is a, c, g, or t
gtaattggttgattggnngnnnggggtggggggccctaatggagaggtgtgggtttggcaagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443881 - DNA, 4770 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcccctatgtcttgtacaaaacgaactattacaaatcggacttaaggcattcctggacatgaacgccgcctcttcccccagaatgtcgaactagaccttttacggcgagcttggctaacaaccagatatattggtgcgaacgaatactcagtgtttt

SEQ ID NO: 443882 - DNA, 1319 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcatcatggttctcgctgaccgaggctgggcgggagaacataagctccatcaaggctgcgggacatggtgtaccgtttgctggaagaacgctctt

SEQ ID NO: 443883 - DNA, 416 bp, Homo sapiens
ctggcctccacttggtcgagtgtgcgtgctctgggctccttgctggaccaagcccatcgtggtatctctaatccatctgctctactgaccctgctgctttctttccctcctaccacatcccactagccggagcaggaaaccacgccgagacacaagcaggaggtactgcatgggacctgtccctccctacccagccgttcccatccctagctcatttgtcaccatcccacagtccatcccaggctcacttccctggcaccatctcagcttcaacttcatctctgctccccagccatccccctctgcagccgtccttgctccccactccgccacccgctaagcttctctctccagctcccttcttagactctcctggccaatcggccatctctccctcctccctcagccctcccacc

SEQ ID NO: 443884 - DNA, 6281 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443885 - DNA, 283 bp, Homo sapiens
gttcagcaggtttctttccgtctaccttgtgagcacagggccttgaacatgctcccactgacagcgagagcagggaactccattctcacatcccatctgcccagtgtggctctgcccacttggcctctagttcccttctctgccttcctgggacagcaccctgcttcacacctgtaccttcttctgactacctcactgccctgctggtggcccacccagctgccctggcctccacttggtcgagtgtgcgtgctctgggctccttgctggaccaagcccatcg

SEQ ID NO: 443886 - DNA, 5941 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccatcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443887 - DNA, 6367 bp, Homo sapiens
ccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443888 - DNA, 6268 bp, Homo sapiens
tctcctgctggcttctgagagctgacggaacaggttccagcaaggcagaccctgacacagaagccagacctgtccagcagggaccccatacactgggaggcttcctgggaaactggaaggcagaagccacgcagacttctagtcctggttccactgcttactcggctgctgttcgtacctgcctcatggttttcttggggaggatcaatgaggtagaacctgcaaagggcttagcagagagcctagcacctactgagcgctcagtaaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443889 - DNA, 5967 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443890 - DNA, 3949 bp, Homo sapiens
ccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 443891 - DNA, 2571 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctgacatcttaatctgggcccagcctgctggtccggctcacttt

SEQ ID NO: 443892 - DNA, 1103 bp, Homo sapiens
agcggagtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagggccaggccatcctgcgcagccagaagcctgtgatggtgaagaggaagcggacccgccccaccaagagctcctgagccccctgcccccagag

SEQ ID NO: 443893 - DNA, 395 bp, Homo sapiens
tcccgagtagctgggactacaggcgcccaccaccacgccggctaattttttgtatttttagtagagacgaggtttcaccgtgttagccaggatggtctccatctcctgccctcgtgatccacccgcctcggcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443894 - DNA, 712 bp, Homo sapiens
cggacgcgtgggtcgacccacgcgtccgaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgtccagtgcaagtgactcagtcatcagtgggcacacactgcagggtgcctcagggaatgccagttcttccaaagagcaaagcacttcacattccaaagtgaattcccaccagtcagcttcattctttccttcttctccaggccttcctgtggcagggaatagtgggtttgtccaagattatacaacaagtaaattgggctggggctcaaatttacaccctttcctctgtgccagctccctggtgaagttccctctttctagagtcagtaagcaggattgtcatggatgctgccaggaagtgcctggta

SEQ ID NO: 443895 - DNA, 546 bp, Homo sapiens
gcggccgcctactactactaaattcgcggccgctcgagaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgtccagtgcaagtgactcagtcatcagtgggcacacactgcagggtgcctcagggaatgccagttcttccaaagagcaaagcacttcacattccaaagtgaattcccaccagtcagcttcattctttccttcttctccaggccttcctgtggcagggaatagtgggtttgtccaagattatacaacaagtaaattgggctggggctcaaatttacaccctttcctctgtgccagctccctggtgaagttccctctttctagagtcagtaagcaggattgtcatggatgctgccaggaagtgcctggta

SEQ ID NO: 443896 - DNA, 1475 bp, Homo sapiens
aaagtcgtaacaaggttggggtaggtgaacctgcggaaggatcattaaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443897 - DNA, 1466 bp, Homo sapiens
  misc_feature (1452)..(1452): n is a, c, g, or t
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataacaaaaaaggaaaggttggccccccggggtttctccccttttaaaaaaaanggatgattttctta

SEQ ID NO: 443898 - DNA, 1319 bp, Homo sapiens
aggagacggcctcgccgtgcccaggcggtcgcggaacccatgccacctcgcgctcctctgacctgggctcgccctgcttccctcaaggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443899 - DNA, 1260 bp, Homo sapiens
gtcccccgttcgatggccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443900 - DNA, 1184 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443901 - DNA, 925 bp, Homo sapiens
  misc_feature (833)..(833): n is a, c, g, or t
  misc_feature (835)..(835): n is a, c, g, or t
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggaggggaatgggcaggcaagccagtcttctgtcttctttgcccnangtccccacaaagccatgtaggagctgagttcttaaagactgaagacaggctattctctggagacaaacttaacatggaaaattgtacttt

SEQ ID NO: 443902 - DNA, 1354 bp, Homo sapiens
aatttattttttatttttttctattgctgctgcacaaattacctgtgttttaaatgttgacaaaagactgtgcactgtgtgaggccaacaaaacatacctaaaggccagatccagcccccagcctgccagtttacagcctgtgcccaccatcttcaaggagcagtgtgggagacctaggcagagggcttagagcaagtccactcctgtgtgctccaggacagctctgcctcgtggggtgataccacaactaccttacctctctcccaggcaccagggcaggactaggtgagggctatgcctgacagatgaagaaacagacttgggagaatgagtaggttgcctgagggtaaagatagtccccaggtagagtgacactttgcaggcacttggctggaacctgggcaaagctggctgaccttgggcatcctcttggtctgggaatcagcagttctagcagccccagccaactcaggctcaccttatattcccctgcagtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443903 - DNA, 726 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccagagcaccagcacgaattcccttagcaccagcacgaattcccgtagcaccagcacgaattcccgtagcaccagcacgaattccctt

SEQ ID NO: 443904 - DNA, 403 bp, Homo sapiens
gcggccgcctactactactaaattcgcggccgctcgatcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443905 - DNA, 664 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggacgagcaggagagcgcgcggcagaccagcgagagcacgacaagcgggcgcgtgctgtccaatc

SEQ ID NO: 443906 - DNA, 547 bp, Homo sapiens
aaagtcgtaacaaggttggggtaggtgaacctgcggaaggatcattaaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctggtaagtgggcccatgtgagacttgcaggtttcagccttcatcctttggtgaggactgggggactggtggtgctgtgg

SEQ ID NO: 443907 - DNA, 1459 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443908 - DNA, 1620 bp, Homo sapiens
  misc_feature (1489)..(1489): n is a, c, g, or t
  misc_feature (1491)..(1491): n is a, c, g, or t
  misc_feature (1495)..(1495): n is a, c, g, or t
  misc_feature (1500)..(1501): n is a, c, g, or t
  misc_feature (1506)..(1506): n is a, c, g, or t
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgaaaaaaaaaaaaaaaacaaaaaattttggngngccnggccnngaaanttttaaacaacttggggcggggccaagtttggagggcagcgggcaggaaaccgggagaggggggtcaccaaaagcggggacgaggggaaacagggtgggcaggtcaaggcggtt

SEQ ID NO: 443909 - DNA, 1071 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactggttaggatgctgtcggtaccgagctcgagtcgtata

SEQ ID NO: 443910 - DNA, 1181 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgactttcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443911 - DNA, 1105 bp, Homo sapiens
gacacaccacctcatctgcccacctcatctgcgacaccaccaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443912 - DNA, 1123 bp, Homo sapiens
ggcccagtctgttggctaaatgaacagatgaaggaaagtcggggatgagctgtcagtctctggcaggaagatggagcagggctaccagatttcccttatctcctttgtctgtcctcagagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaggggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 443913 - DNA, 976 bp, Homo sapiens
acgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcgggtgagtgactgggccgggagcagtgggcttctccctagaagctgcccactggctcagccaggaatttcacattaaattcattctgagacccccaagggacttacctgcactgcattgtaggtcgtggggcgggtattactaactcgaccttgtaattgaggatacagactcgtaagaggctgtcattgccctaaatcacagttacacacagaatggcacagtagcatttgataccaacaccttgggtgctgtttcagtgggtccacatgctcccaggaccagggtctcaaacttaccggtgaccaggaaccagagattaccataagtgaatctgtgaccttaaggactagtagggcagtgacccatctaaacaag

SEQ ID NO: 443914 - DNA, 2110 bp, Homo sapiens
agcgcgggaggcggggccgcggcagccggctgggtgcgactgggcggcctcggagctcgcagacgctcgggggaacatggcggctgcggagccggcggtccttgcgctccccaacagcggcgccgggggcgcgggggcgccgtcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttattagagggttttgaaatgtttttcaaatatgtgaaatgtgaaactgctgtcttttatattaaagtaattaaagaaaatgtattgtgattgaaattattttggcctccacaagatggctctatgagtattcttccagggattctaatatttatttaaggtaataaaatcttgacatttataatctttc

SEQ ID NO: 443915 - DNA, 1508 bp, Homo sapiens
attcgttatggcggcgcgaggcaccattgaatgtaaagctagagacgatggatacatgagctcgtttctcaccatagagcacgaatccttgtgctcattggatcatatgatgcatagagatttcatcgaccgcgacaataaaacaacagcactctggccggcaaatccagaggacgttgtcggaatcaatatcgcagattggaagttctgtagtgtcgattactggatctatcaactgggagtccatagcggagctcggagtatcaaagattacgctccgctgtgccttgatgccacctcatcaagaagcatgatggacaggatgtttgccctcgagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttattagagggttttgaaatgtttttcaaatatgtgaaatgtgaaactgctgtcttttatattaaagtaattaaaga

SEQ ID NO: 443916 - DNA, 1224 bp, Homo sapiens
  misc_feature (29)..(29): n is a, c, g, or t
  misc_feature (36)..(36): n is a, c, g, or t
aacatttaatgttctcaattttaatattnacaagcnagttcagggaaatctgacgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttattagagggttttgaaatgtttttcaaatatgtgaaatgtgaaactgctgtcttttatattaaagtaattaaaga

SEQ ID NO: 443917 - DNA, 1997 bp, Homo sapiens
agcgcgggaggcggggccgcggcagccggctgggtgcgactgggcggcctcggagctcgcagacgctcgggggaacatggcggctgcggagccggcggtccttgcgctccccaacagcggcgccgggggcgcgggggcgccgtcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttattagagggttttgaaatgtttttcaaatatgtgaaatgtgaaactgctgtcttttatattaaagtaattaaaga

SEQ ID NO: 443918 - DNA, 1934 bp, Homo sapiens
agcgcgggaggcggggccgcggcagccggctgggtgcgactgggcggcctcggagctcgcagacgctcgggggaacatggcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttattagagggttttgaaatgtttttcaaatatgtgaaatgtgaaactgctgtcttttatattaaagtaattaaaga

SEQ ID NO: 443919 - DNA, 1264 bp, Homo sapiens
aaaggatcttttagaagatagtttgcagtttgaaaagaaacttaatattttacttgcctattcccacttcttaatcagcagtaatggaatacctcctgattctaggttacttaatactaggtttctattgaggtctatttttagagaagggaaaagaaacccagttttatgatatttaaaatgataccattatatacataagccacatatatttccctttttttcatgttcatgtaggatagttgaatgcaaaatagtgaatacattcattagtgtttttcctcataatttaaaaattttcattgttagatcctcaggatacctaaggttatagctaggaaggtaaagaataaaatctgcccttagttggaacaatgccctagtcttaattgaagctgccttagctaccttcctccaaccaataaataaatacatactctccagtttaatgtatatttttgccattaagaagagttgagactgggcatggtggctcatgcctgtaatcccagcactttgggaagctgaggcaggtggatcacttgacttcaggagttcgagaccagcgtggccaacatggcgaaaccccatctctagtaaaaatacaaaaattttaagtggctattaaatgaagagttctgtgggccagatgaaccaccgcatctgacgctcagaactctgtttcatagccgcttagctctaatcattagaaatgtatttctcatatttaggcccaaatctggttcccggtaactactacccattagttgtagttcttttcctcataatggccctaaggttattgaagacttgtaatcattctttgttctccccttcccaagataattcatttattttgatgatctaaacagttgtagtacagtgtgctactacatacttctctgcctttgagttttggatccagaagatttttagtactataaattcttcagtatgcaatgataatggtgtgaaattttagatagttttgcgtaaaatactttatgttgcagagtttttaggctaaataacagtaaactagcattttatctttaatgtgtcatccttaattctaaataatgactactaatctagaacatttgaattacctcccagttttccagatgatatcttaagaaagattctaaagttttacagcctgcctgcagaactatgatgagattttagaaataatccactactttagttttcagcctttttgagtatgacgtttctctttctaatgttaaaaaagttacatatt

SEQ ID NO: 443920 - DNA, 1179 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443921 - DNA, 1862 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcaggtcagaagtcccttttggttcctaaagactttacccctcttcctcccccaccctccagtgctttttctccctaacccaaaaggcggctctgcatatgcttggtgaagcactggttaggaactacgctatcgcaccgccgacctccaccgtaggggttcgtgcaagagggtcacagctgcgtctgggagtcggcgcccagagatcccggctggccttttgcggagcctgagcctttgagtccatttagtggaatccgcatcccacacctcaagactcctccggcggaagtacttttgggcgggcgcggtggctcacgcctttaatagcagcactttgggaggccgaggcgggcgaatcacttgaggtcagtagtttgaaaccagcctggccaacatggtgaaaccctgtctctactgaaaatacaaaaaaaattagctgggcgtggtggtgggcgactgtaatcccagctagtccggaggctgaggcaggagaatctcttgaacccgggaggcggaggttgcagtgagccgagatcgcgccactgcactggatcctgggcgacagagtaagactccgtctcaaacaaataaaataaataaaaataagaagtagtacctttggcccaggttgtatcggggtcccggcctgttaccttcgtcgtttaacttgatttgtctttgtagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443922 - DNA, 1597 bp, Homo sapiens
gtatgtagctttgctgttgaactggatggcatagaccagattataaagtgtttttagccctcgggttcctcttctataaaatggagattaaaaatactacctgcctaatatcctgtttgttgatctgggtaatagtggtgtgtgttcatgtgttcactttctggtaattcactgagctgtatatttttaatttggccctttgatatagctgtgttaaactttgacaagtttaaaatttttaaaaagagagccctgaaagaataccaaggctataaagttattttaaagattaagtgaactagtggtttccaaacaatccctgttacagtgttaagcacagagttggtgattaataagtgcatttggattcagaggataaaactttgctatctttaaagttttagaaacatttgcattagccactgtcacagccagaagattccagtgtcactaaaagcatctgcaaaaatgtaatatacctttacagttactgttcagtggtaactttaagactttcaggctggatatggtggctcgcacttgtaatcccaacactttgggaggtaaaggcaggaaaatcacttgaggccaggagtttgaaaccaacctgggcaacatagtgagaccctgtctctaccaaaaaatgaagaagaaagaaattaagactttcacctgttataaatctttctaggaaaatagatcttttgagatgtatagttttactttatcctgggttgtctgtgcttcttttagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443923 - DNA, 1140 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagatcctgggttgtctgtgcttcttttagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443924 - DNA, 839 bp, Homo sapiens
accgctaaccaacttcaaagaaagtagttgagatccttgcacttccaagtgtgatggaaccaggctagggtttctttgtttgtttgggcctcttcaaaacgtttttattctgttataaggaatatgataccttaagcttcaattcacagggaagagaaacatgattataagcaaaagtttgtcaaggaataaggtgagtctttgtgtagaaatagaccgttcaatttctacacatcctcgcccacatatcttatttaaggtggtagtgtaatttacagcaaggacatcagctctgatgtttacaaagaaaaccagcaactctgatgtagcaacatacgtgtagaaattgaacacacagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443925 - DNA, 1175 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcaggtcagaagtcccttttggttcctaaagactttacccctcttcctcccccaccctccagtgctttttctccctaacccaaaaggcggctctgcatatgcttggtgaagcactggttaggaactacgctatcgcaccgccgacctccaccgtaggggttcgtgcaagagggtcacagctgcgtctgggagtcggcgcccagagatcccggctggccttttgcggagcctgagcctttgagtccatttagtggaatccgcatcccacacctcaagactcctccggcggaagtacttttgggcgggcgcggtggctcacgcctttaatagcagcactttgggaggccgaggcgggcgaatcacttgaggtcagtagtttgaaaccagcctggccaacatggtgaaaccctgtctctactgaaaatacaaaaaaaattagctgggcgtggtggtgggcgactgtaatcccagctagtccggaggctgaggcaggagaatctcttgaacccgggaggcggaggttgcagtgagccgagatcgcgccactgcactggatcctgggcgacagagtaagactccgtctcaaacaaataaaataaataaaaataagaagtagtacctttggcccaggttgtatcggggtcccggcctgttaccttcgtcgtttaacttgatttgtctttgtagattcctgggcactcctccccgccagtgctggcgtaaagacactgctcccagtaccaagttttgaaggatgataaagaagatgtcacatgtctggcctgaagttttgcccacccaccaaaacctggcacactgacctgtgcaggtctcagcatgaaaagtccctgcatatatgagagaaagagcattgatcaaaggattcctaggttgtaagtttctcaacaag

SEQ ID NO: 443926 - DNA, 274 bp, Homo sapiens
ctggcgtaaagacactgctcccagtaccaagttttgaaggtgagagcttgtctttctcctgttcgtaaatcttttctctgatggaaaccaggagcgggtgggagatgacataggaatgttctcgtgtttcccatccccgttcactctttcaataaatatgtttttagagcttacagttttgccaactaatattctgagcactagaaataaatcaaagacaaaggaaaccaaaaaagttccttgctcttacggagcagcgtctaatgagatagct

SEQ ID NO: 443927 - DNA, 1649 bp, Homo sapiens
  misc_feature (1190)..(1190): n is a, c, g, or t
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggataaaaaaaaaaanaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaccttgtggcccccttggcccaatcaactttaaaattggaaaagttttttaatggggccccaatttgggcctacttggccaatttccccttaagggggcgcgttaacaaataacggggccggtttttaaaaacttgggactgggaaaaccctggggttccccaatttaataccctttggaaaaaacccctttttccccactggggttaatgccaaaaggccccccccggagggcctttccaaaaaggggccaccccgaatgggaaatggaaattggacgcgtaaaatttgggtaaaaacccggtgaaattttggaaaacccgccattttttaacccaatggcccaaatcgggcccttttaacgtgcccc

SEQ ID NO: 443928 - DNA, 1543 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcaggtcagaagtcccttttggttcctaaagactttacccctcttcctcccccaccctccagtgctttttctccctaacccaaaaggcggctctgcatatgcttggtgaagcactggttaggaactacgctatcgcaccgccgacctccaccgtaggggttcgtgcaagagggtcacagctgcgtctgggagtcggcgcccagagatcccggctggccttttgcggagcctgagcctttgagtccatttagtggaatccgcatcccacacctcaagactcctccggcggaagtacttttgggcgggcgcggtggctcacgcctttaatagcagcactttgggaggccgaggcgggcgaatcacttgagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443929 - DNA, 1125 bp, Homo sapiens
actcaacctcccccggaactcaacccccgtcgctcgagtttctttcgcttccgtcgggactctgcggagtggacccgagtgaacacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagcttagatttattgaaagggcaccacttgtgccaaaagtaagaagagaacctaaaaatttaagtgacatacggggaccttccactgaagctacggagtttacagaaggcaattttgcaatcttggcattgggtggtggctacctgcattggggccactttgaaatgatgcgcctgacaatcaaccgctctatggaccccaagaacatgtttgccatatggcgagtaccagcccctttcaagcccatcactcgcaaaactgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggacatttgagcgaatagccactgccaacatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaaaacaatgttatttgttgatttaaaaagaaaactgtatttttattaaataaaatttaaacatcacttcaggata

SEQ ID NO: 443930 - DNA, 474 bp, Homo sapiens
aattgtatcattgaagccacagttactagaagagacaaaataatgagcccatagatgatgtcgaagtccgcatgtgtttctaattctcccattcacttttaggcattgggtggtggctacctgcattggggccactttgaaatgatgcgcctgacaatcaaccgctctatggaccccaagaacatgtttgccatatggcgagtaccagcccctttcaagcccatcactcgcaaaagtgttgggcatcgcatggggggaggcaaaggtgctattgaccactacgtgacacctgtgaaggctggccgccttgttgtagagatgggtgggcgttgtgaatttgaagaagtgcaaggtttccttgaccaggttgcccacaagttgcccttcgcagcaaaggctgtgagccgcgggactctagagaagatgcgaaaagatcaagaggaaagagaacgtaacaaccagaacccctggaca

SEQ ID NO: 443931 - DNA, 3163 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443932 - DNA, 1132 bp, Homo sapiens
cgtctcctgctatcgtaccttacatactggacctacggccgttcgtaatggaagcatgtgctccccaccatatgcctacagtgacgttgtggcagtgcgtcctatctgactgtaaacatctggatctgcatacatatctccggagatatgcatgggccttgtacccatctaagacaaaaaaccatgcttgggtgggttactaacctcgtcaattgattattgagtatttgcattgggcaagaacggaatgttagaaatctgtaatactgtatgctgatggtaaacttactgtaaggatctcatttgggtatctggaaggtgatagttctgtttctttgttatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctattaagtttggtgtgtgaagtccaacaccttatcaactaggctttccctctgacatcttgaagcctccgtgtatatcctttggactctgcagcaaagtgcatcagttgttagtttactctgagcatggtattcttagattgaaaagaagtctctgaagatgtcaaataaaatgtaaacattttctccagcagtgtgaagtctagtgagttaatgtttggcacaagcaggtaatttacatccattctatagggtagtagaaatgtgatctgggcaagtcacagtggctcatgcttgtaatctcagcactttgggaggctgaggtaggaggatggcttgagctcaggggtttgataccagcctgggcaacatagcgagaccttgtctctactaaaaattaaaaaaattagctggatgtggtggcccacccctgcagtctcagctgtttgggaggctgaagcaagaggctagcttgagcatggagatcaaggctgcagtgagctgtgattgctccgctgcattccagcctgagtgacagagtgagacactgtctcaaa

SEQ ID NO: 443933 - DNA, 475 bp, Homo sapiens
tccagcctgggcaacaagagcgaaactccgtctcaaaaaaaaaaaaaaaaaaaggatactaattttctggtagagacacatttttgaaagtactaaagacaagttattattaagaccaaaagaaaactcacttaacagtgaaaagtatttgtgcccttgcggtgctgccttccattaatcaaggtcaggggagaaatgggataatagccctttaaagaggacacttgtctttctccctcagatagagccatggtttgttactgagtgtttaaatctgattctctctgtagattgctgctaaaattgattcaattcctcacttgaataattccacacctctagtggacccctcagtatatggatacggagtacaaaaacggcccttggatgatggaggtaagttgccagaaatatctttgcctttcaggtggtagtgaacctgccagttaagtttgaatttgtcagccattacctt

SEQ ID NO: 443934 - DNA, 4018 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443935 - DNA, 3237 bp, Homo sapiens
  misc_feature (445)..(445): n is a, c, g, or t
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggagcgtgagcacgatttcacggcattcaagcacgacatcctgcgntttttggccccaaacaacaaaactttttccaaaaggaaacttctgggggccttttttcccaacgagaaaacgggaagggttttccttggggggaatttcacaggaagaaggccctgtgtacttaccggaaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443936 - DNA, 3358 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtccaaaaaaaaaaaagaaaacaacagtgttgggggcacctgagaccctgcaaaaaaggctttttggaaccatctcgggggggcgcgcgcccacgttgagacgcaaacggggtacaacgacgggtcccagaaaaacccggggcagaaaagggggggagtctccacaaaaaaaggcgcgggcaacggcgaggttgaaac

SEQ ID NO: 443937 - DNA, 2900 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443938 - DNA, 3104 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattactctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443939 - DNA, 1585 bp, Homo sapiens
tgtgaggagcccgtaaggcctgactgcttttgtgttcttcgcacaggccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443940 - DNA, 2469 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatgcttaaattacaggttagtaggcaaatgagatgaggactaaagttgtaggtcacacttttgttagctctttaaccctgagcaagttagttaagttttgtctcaaaaccttaagaattctctggctccttagggtgggtgtgagggtggactggaacagcagcagcctgcagtgagggagctggctacacttcagggcgtggggccatttccctcggttttgaagctttgctttagaggttaaccagttgcccaggtaaaaaccaaagttcaggttttcttggtgatgtatatcatgattctgtcaaactcagcagcctgtgtttattgatgaggttgcaatggggtcagaatctatcctagagaatgaaattttgttgtatgcgacaacatggatgaaccttacaaacagtatgctcagtgcaataagacagatacagaacaaatattgtacgattccacttatctgaggcacctagaagaggcagatgcatacaggcagaaagtagcaaaagctgtcagatgctgggggaaggaggagtattgtttaatgggtacagagttgttggggatgatgaaatgttttggatatggatggtggtgatggttacacaacattgtgaatgtatgtaatgtcattgaattgtgtacttacaagtggttaaatgataaatattatgtatattttagccacaataaaagaaaaatgaaggaaaaaaatgcattttaaagaaccgctagggctatgcatggtggttcacgcctgtaatcccagtgctttgagaggcttaggcaggagtactgcttgaggccaggagattgagatctgtctgggcaatatagccagacaccacctctaccaaaacaaaaaaaaaagtattttaaattagcctagtgtggcacattcctatagtcccagctgttctagaggctaaggagggaggctcactcctcccaggagatcgaggctgtagtgtgctacagttaacaccactgtaacccagcctggataacaagtccagcccaggtaacagtgtgtatggtgtgtttattggaaggcaaaattactatttttcatcttttatctataaggcttattcatttttataaccattttgatcaaatctcaaattggatgcatttaacagttaagaatgcagttcaggccgggcatggtggctcacgcctgtaatcccagcactttgggaggcagaggcgggtggatcacaaggtcaggagttcgagaccagcctggccaatgtggtgaaaccctgtctctactaaaaatacaaaaattagccgggtgtggtgacgcgtgcctgtagtcccagctactcgggaggctgaggcaggagaatggcgtgaacctgggaggcggtgcttgcagtgagcgtagatggtgccactgtactccagcctgggcgacagagcaagactctgtctcaaaaaaaaagaaaaaaaaaagaacgcagttcaaccacagtattattcctaaaagggaaaaatgtcctttattatatcatttccaggaatgcactataataaaaactaagttgcgtgttaaaaaaaaatgtgtcctggg

SEQ ID NO: 443941 - DNA, 552 bp, Homo sapiens
aaagaggaaaacatggcaggctcttctctggaagctgttgccatagctctgctctgactcccttggcttttttaaagtcaagctttgttttagttctttaatgatacattttttaaatggctataattgcataagaattgagcattgacctgaaacatgcaaaacaatataatgacacacattttcctatcacccacatcactccaaaagagtccctgcagctggcagtattcctgttgccccttttggcaccgcgggtgagaatattgattgggaatcagattaatccttgtttccttctaacgttgggcttttttctaatcctgtctctcacctggctcctcagatgatgggattagtccagaaagagctgcccaggtcatgggccctccggatcggtgtcagcatgcagcgcatatcatcagcgagctgattcttacagcccaggtgggtccagctctgcagagtgtgagtgtttgggctgcagaagtggaaagtgctacccggggctctcggtgcagcaccatagagctgtcaccctgaggcgtctca

SEQ ID NO: 443942 - DNA, 2533 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagcgatgggatcacactctgctcaggctagagtgcagtggcgccgttgaactcctgggctcgagtgatcctcccacctcggcttcccaagtagctgggactacaggcatgagccaccatgcctcctataggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443943 - DNA, 3288 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagcgatgggatcacactctgctcaggctagagtgcagtggcgccgttgaactcctgggctcgagtgatcctcccacctcggcttcccaagtagctgggactacaggcatgagccaccatgcctcctataggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443944 - DNA, 3187 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtcaaaaaaaaaaaaaagacagaaaag

SEQ ID NO: 443945 - DNA, 3922 bp, Homo sapiens
  misc_feature (3540)..(3540): n is a, c, g, or t
  misc_feature (3637)..(3637): n is a, c, g, or t
  misc_feature (3866)..(3866): n is a, c, g, or t
  misc_feature (3911)..(3911): n is a, c, g, or t
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaacaagaagaagagagatgaccaaagatagcgcacgctaggacgagacgcgaaataaaaacgaaaagcagaggaggaccggcgagaaggaagagagaacatcgagaagagcagagatgcacaagaataggaacaactgagacgccatacgtgacacggagaaacgacgcgagctggtagaccgagaggaggcggtgaagagaacgtagtaggttagaagaacgagaatgcagatcgcgggagcgaagagctatgaatcagagcagaataaagttagaaatagagacaacggtacaacaagagacaagcaagacaggacaatctaataagaaaagagcagacagacaagccgacacagtaagagaaagacagcgaagagacagacgcaganacgatacacagcagatgacagcacaaaagagcacgcatcaacgcacgtcgagagcgacacgtagagactaagcaagcaaaagcacaagagcaacgtnagcaagttagaagcagagctacagaagacgaagtcaataccgcacgcgcgtcgatcgcagcgaagtaagaagggacgacagacctaacgcacactcagatacgtaaaaagcgagaaacagagacacaagtacgacgaacacagtaagcaagaccgaagaaggaaatagcaacatcaaggaaagcagaacacatagccagcacgagcgcaacagcacacgcgaacaaaanacatagaagtcaacgaccaagacaggaagacgaccctgacgcgangcaacgagagg

SEQ ID NO: 443946 - DNA, 2187 bp, Homo sapiens
tatctgaattttgcaaccagattctgcttgaatccgtgaaatctgctcacctcccctgccgataataaatccaaccattttgtcaggcactttgaattcttccgttattaccgtcctttgatgtaccaaggcccctaactggttacctactccatcatccagggccgtttttgtactccgtatccatatactgaggggtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443947 - DNA, 1610 bp, Homo sapiens
acaccagcctcacctcactgcctcccagacctccctgccttccagccgtccggagggagagcagatgcccagggcctttgggaagggtcctgcccagtgcacctccgctcccgataacctgtgtttcctcctttgtcaaccaggtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 443948 - DNA, 1993 bp, Homo sapiens
ggcgactttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagaaagccacaggagtcattgtattagaagaaggtcttcactcgggcgcttgaagatatggtctttacatctctttccagtattccaggggagggaaccctacctgtttccctgataactgacttttcatgttatatattgatgctcctatagacattatattggatcccagaactttccaaacctgtggttccacctaaaattttatctgatgaattgttactttactgcctagctgccaaccagtacagtagtgagtatccatcttacttagacttcagatccacccatggctgtaatggatgaacatgccacccagctccccttccaccactctgcttgctggcgtgttacagtgctctcctctacagtacagggtcctgaaccttgtttctcactggctactaatatgtaatggctttcgctctgtgctgatgtgtgacagtcaccttgttggccttctatgtccgggaagaattatagtcactgccctaaagggctcagatcctcagtttgcagaaggcctgtagttgaacataaagtgaattttgaaccattgagaagacattccgcttctcttgagccagtggttgaactcatattcttggacaacctgctccagagggagaccctctggtaaatgctgacctaatgtggattgttgaagcagtggtgtttactactagcagtgaaaacttcattggaattgttctcagctctgaaatgcaccattgactggagcagtaataagcccaatggagacagggctgtaagtgtgttccttctgaatgttaacagctggaggtccatactatctccaaggatttgatggcctttaaaaactaaagaaaaaccaggttggtgggtaattttaggtttattgtatatagatttgcattgggcaagaacggaatgttagaaatctgtaatactgtatgctgatggtaaacttactgtaaggatctcatttgggtatctggaaggtgatagttctgtttctttgttatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctattaagtttggtgtgtgaagtccaacaccttatcaactaggctttccctctgacatcttgaagcctccgtgtatatcctttggactctgcagcaaagtgcatcagttgttagtttactctgagcatggtattcttagattgaaaagaagtctctgaagatgtcaaataaaatgtaaacattttctccagcagtgtgaagtctagtgagttaatgtttggcacaagcaggtaatttacatccattctatagggtagtagaaatgtgatctgggcaagtcacagtggctcatgcttgtaatctcagcactttgggaggctgaggtaggaggatggcttgagctcaggggtttgataccagcctgggcaacatagcgagaccttgtctctactaaaaattaaaaaaattagctggatgtggtggcccacccctgcagtctcagctgtttgggaggctgaagcaagaggctagcttgagcatggagatcaaggctgcagtgagctgtgattgctccgctgcattccagcctgagtgacagagtgagacactgtctcaaa

SEQ ID NO: 443949 - DNA, 452 bp, Homo sapiens
agcacctacctcgcagggctgaggtaagactcaccgagataatctagcaaagtacttagcagaggcctggcacacagtccatgtgcaatgggttggttcctagtactgtgctcactgaatctaaagagtttcagtaacttggggcttgaagggttattaagggaaataaaggggcttctctttacacctcagtgcctatgtgagacatggaatatttagccagatgtgatgctgatctgccccctgccgcaggacccatgccagggcacagggcacttgctatgtgtctctctcttgactaggggactagggagccaggagatgcacctgagtgagatggggactccagcaccttcttttaactggttacgccccgctagaccatctgcatgtcgagggtggggactgcatactctccacaaagcatggtgcctctggcaggcactctgtaa

SEQ ID NO: 443950 - DNA, 865 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443951 - DNA, 679 bp, Homo sapiens
aggccacccacggctacccatggaccaatcagcacatactttctctcctctgaggcccataaaagccctgcgctcagccagaactaagcagatatctggatgaccagctgcagaaaggagctactcattccagggcctcctctctgctgagagcagcagacatcaggatgaccagctgcagagaggagctacccactccagggcctcctctttgatgagagctgcagagacagtgggacaacctgtctgcagagaaaaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443952 - DNA, 483 bp, Homo sapiens
atgtagagaatgctgccgggactgacccatgtcttttctgaatcacctctgacatatgaccaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443953 - DNA, 495 bp, Homo sapiens
  misc_feature (95)..(95): n is a, c, g, or t
ttccccgctcacgcttctaggttgggaaaggtggtattctgcctaagtgaagaaagcgggagcgtgatctgaaaggaatacaacatgtttaagancacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443954 - DNA, 474 bp, Homo sapiens
  misc_feature (74)..(74): n is a, c, g, or t
tacaagagcagagcggtattcctaatataaagaaaataagcgagagggcgtggaggatacaacatgtttaagancacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443955 - DNA, 370 bp, Homo sapiens
tgggaataatgtcaccaatagcataagaattaatgtctactatgatgctgaaataaataaactggtaaaactactctgctgtctaaatccccaagttacaaatttacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagagcaagaaggcccttgccagatgccaccccctcaatcttagacttcctactctccagtacagtgagccaaataaatgtctgttcgttataaaaa

SEQ ID NO: 443956 - DNA, 1015 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443957 - DNA, 866 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443958 - DNA, 1110 bp, Homo sapiens
tgggaataatgtcaccaatagcataagaattaatgtctactatgatgctgaaataaataaactggtaaaactactctgctgtctaaatccccaagttacaaatttacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcatagataaatcccagttgacagaactgtttaagagatgaatgtgctcccaactgggattacggtcacagtatttatctatatcaactttcatgttacttcactggcaaattgggagctttggaggataagaggataacatatgatcgggagaatctattttctgctctgaaggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443959 - DNA, 628 bp, Homo sapiens
catgaaggtcttcaccagatgtgggccccttgatcttggacttcccagcctccagagctgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443960 - DNA, 632 bp, Homo sapiens
atgtagagaatgctgccgggactgacccatgtcttttctgaatcacctctgacatatgaccaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443961 - DNA, 847 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtttaaaaaaagaaaaataaagagacaaaatcaaaataggaaaagaaataagaaaatttggcctccttggcctcaccggtggaactttcaac

SEQ ID NO: 443962 - DNA, 716 bp, Homo sapiens
gctgccttgcacttagggaaggttcacatgcctcaaggatctctctctctcagatttcttgactttccctcagtcttcagtatagtcctcctctgtgcctggtgaagacctgtggtaaagtgctggcagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattaggaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatccca

SEQ ID NO: 443963 - DNA, 607 bp, Homo sapiens
tgggaataatgtcaccaatagcataagaattaatgtctactatgatgctgaaataaataaactggtaaaactactctgctgtctaaatccccaagttacaaatttacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagattctcctgcctcagcctgccgagtgcctgggattgcaggcgcccgccgccacgcctgactggtttttgtatttttttggtggagacggggtttcgcggtgttggctgggctggtctcagctcctgacctcgagtgatctgcccgcctcggcctcccgaggtgccgggattgcagacgggagtctcgcttactcagtgctcaatgttgcccaggttggagtgcagtggcgtgatctcggctcgctaaaacctccacctcccagccacctgccttggcctcccaaagtgctgatgcatactctgcgccaggtcatcccagtcacgactaagt

SEQ ID NO: 443964 - DNA, 328 bp, Homo sapiens
tatcctttataaaaattaaaagaagaagaaggggaaaaaaatcctcattaatgtatgctggcaaaacaatggcagtcattttcctggctgaaaactaaattattgtgcattgtagtgtgcatgtctatgataagtagattactatagatcattccgagaggaggtagaaggaagattgcactaacattagcttctctggtatttgcaggctgtaaatttcgttgaatgatggatgcaaagatggaagacagatggatagaggaaaagacagaatcagatactggatgagttagtactgctgcctgtgcttcagagctgtcttattacc

SEQ ID NO: 443965 - DNA, 942 bp, Homo sapiens
tgggaataatgtcaccaatagcataagaattaatgtctactatgatgctgaaataaataaactggtaaaactactctgctgtctaaatccccaagttacaaatttacagagctgccggcttccccttgaaggaataggagtagacctgctgaactatcacatgagagaagaggcccaaaagcttgcacactacagtcaagctggcccttaaagagatggacctagaagatgctgagccagatgtactcaattacttctccaaaattcatcaattagaactgcttcttgctgccgccatatgaagaaggacgtgttcgcttccccttcctccatgattgtaagtttcctgagacctcgccagccatgctgaactgaatacaacatgtttaagaccacagaacatctgcataggctgtaaatttcgttgaatgatggatgcaaagatggaagacagatggatagaggaaaagacagaatcagatactggatgagttagtactgctgcctgtgcttcagagctgtcttattaccacaaggccggcaagcatcaatgtccccacatccccctctgcctccccctgaaatgtaccgatttatatgaaaattaagattacaaattaaagcctggctatcctggagttttccagttcatcagccatccaataaaaatgatgtcaagcctgtatgcataattcccggaagattactttcgtccttacagctaagccctgtccctgatatgaaagatctctatccacttttattgaaataaagaactaacatcataatcccaatattgaggtataatcttcattatctcctgaccctcttgaggttcccccaatctatattacttcagatttggtttatgtgtaatccttatgtatttacttttattgagataggattaaaaactaaaaaaaaagcttcaaaaaatcctta

SEQ ID NO: 443966 - DNA, 911 bp, Homo sapiens
aagaccctccaccaacaaaaagatgactcactgaaggctcaagtgaccattagcattatttagcaatgaagtatttttaattaaggtatgtatttttaagacataatgctattgcacacttaatagactacaatgtagtataaacataacttttatatgcaatgggaaatcaaaaaattcccgtgacttgctttattgcagtggtctggaagcaagcccacagtattttcaaagtatgcctgtattgtcttaaaatttttgcctcgtttactaaataaggttcttaagggccataatttcatcataacacctaaaatactctgtagaatatcactaacataatgtaggccatttgcattcagaaaccactgacattttgatgtatacgaatctcagatggtatctacagctatgaaacacaagtttttttctgttcgaaagagtttggtggagatacgagtaaggtcagtacccaaattatagtagttttccaaagattgttgtacataatacttctcacttccaaatcaaacagtatttctgcggtgatggtgtatttagagttccaatatgaggcgtccggaatagatctcttgtaataacagagatgaggtttcttccactacctcttccaaactgccttgcttaagagaagtgggaattccttcagctaagacatttggtgttgggacataggggctttcatgtggaaaggaaaaaagaaatagaagaaaagtctgcagggagaagggggaggaccttacacatagcaatctcagctgacacacctaattgccgttttccccttagctcagctgaactgacagtctcttaccttggtgtcagttaagtactgttcccaggtgcctttcaggcactttagcacttatctcgtacacacagacacacac

SEQ ID NO: 443967 - DNA, 4613 bp, Homo sapiens
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggactttggaaatcagtagacaccatatgcttcaaaaaacaggggctattaaaatgacatcaggagccagaaagtctcatggctgtgctttctcttgaagtttatacaacaaccagatcaccgatgtcggagccagactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgaacttgtttggaacttgtcataaaatcgatcagtttggtgaattgcaaccaacaatatttaaaaagaaaacagaacagaacaaaatatcaggatgcaatgtgcatgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443968 - DNA, 299 bp, Homo sapiens
catgagctcaggctcctgggctgacagctctccgaagctcgtggtgaggctcggtctctaactgtgccacttgccgatggcctctgttcacaaggcttcccctgctcttcgatcttgcatcaccccttgaatttgaaatccagagcagcccactcagagaccagtgtgaggaattagtgtccaggccacagatccagggactgggcacaaacatctgcctgttgagtaggaactgagctgtggccattggcaaaaaaggaggggtgagcatggctgtttcttggggagctaacacttca

SEQ ID NO: 443969 - DNA, 4451 bp, Homo sapiens
tctagagcggccgctcgcgatctagaaccccggaccatggcgctctccgggctcttctctagctctcagcggctgcgaagtctgtaaacctggtggccaagattgtaagtcaggagactttccttcggtttctgcctttgatggcaatttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443970 - DNA, 4382 bp, Homo sapiens
caaggtcccctgggacagtgcaaggaaagaaagaagcctgcggtgaaagtgacactgagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443971 - DNA, 2224 bp, Homo sapiens
gctttggacatagccagatcccatctctaaattagccaggtggtgatagcaaacacctatggcccagctatccgggaggctgaggtgggaggaccctcgagacaaggaggttgaggctgcagtgagccgtgatcgtgcctgtgtactatagccagggcgaaagagtgagaccctgtttcaaaacataaaaagataaaataacagtagtacctacttttgagtcattgtgaggactgcaggacttaagaaatattaagtgaggccgggcacggtggctcacccctgtaatcctggcactttacagtgaggcggctgaagcagggctgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443972 - DNA, 3616 bp, Homo sapiens
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttggtaagatcccagcgtttgtcacagtaataacaccagtgactgtttactcaccaccactgactgtgcaaggcacaacgcagggtggtttctgtttattcctccagcaaccctgcacagtaatggtattacctctgttttacagaggtagacagaggcccagaccagtgaaataaggttgcccaaggtcactacgagagaagctagaattcagcccagaatgcctgattccatattctgtgctctcctgccctgggcccccgccctcatctaccttcattgggtgggatgggggaagtggccagtgaaatgatttcctagtggaagtaaatccccctgggactca

SEQ ID NO: 443973 - DNA, 422 bp, Homo sapiens
aggtggggagggagggtgggctcctctacaggtagctgggctaagaaataggagcccaggtacaggatttgcattaaaaatgagtcccattgaccttctgtggggctgacaggctgggcttggagcctggctgttttctgggttctcagcaagtgatcatctgcatagctggagagccttgggctgagctcccgctcctgtgaactctaaaacaatgtctgccaagtaggctctcttgagtaaatacttccttttttttccttaggctgacccaaaatgaactcaacgatgaagtggcagagagtttggcagaaatgttgaaagtcaaccagacgttaaagcatttatggtaactcagagagccttacaatttcagactgtgctacttttcaaaagtattttttgagataaaatttacatac

SEQ ID NO: 443974 - DNA, 533 bp, Homo sapiens
cacctctgtgctccacaggagacatgcaggtgctttctctcatgagctcaggctcctgggctgacagctctccgaagctcgtggtgaggctcggtctctaactgtgccacttgccgatggcctctgttcacaaggcttcccctgctcttcgatcttgcatcaccccttgaatttgaaatccagagcagcccactcagagaccagtgtgaggaattagtgtccaggccacagatccagggactgggcacaaacatctgcctgttgagtaggaactgagctgtggccattggcaaaaaaggaggggtgagcatggctgtttcttggggagctaacacttcactatcttgtctcctccctcaggatgtggggcaatcaagttggggatgaaggagcaaaagccttcgcagaggctctgcggaaccaccccagcttgaccaccctgaggtaactgtggccctgctgtctccaggggccaacctggtccctcccagctgctctaggtttgctggggaagggtgattcgtgctcctaat

SEQ ID NO: 443975 - DNA, 3589 bp, Homo sapiens
tctagagcggccgctcgcgatctagaaccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagaaaaaaaaaacggacgcgtgg

SEQ ID NO: 443976 - DNA, 4373 bp, Homo sapiens
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443977 - DNA, 2614 bp, Homo sapiens
tattttgggtccataatccctcatccagagcctttggggcaagacccgaatggggattctgagtgcatgctatggcatgacgtggccgcaggggtctaaggcagtgccccattttcaaacactttcatatttctcccgcagaatgtatgaaacagtcaaaccaagtgtggtaagaaagactataagtagctccacatcagttgccaaaagaattgtgagaaactttgggcattcagagcctttgaggttttggagtctgagagaagggattgcgggccagccccacacaactggtggctctgcaagctggagcagttgttcagtttcttggggcctcagtggccttcgatgttaatgaggacatggacgcaaacgaccccgggccacactcggctccagggctctgtgtggctgtggaaccctggaagcctgagcttagctgcctttcaacttccatctgctgtactattgaattggcattgagcggtgagatggctgaaaggtagacatcgagaagttttaatattcagaatcttttcttctcaagacgctgaatgtaatcttagttgtaaatacccatcacctgccagtcaccgagcactcatgcaccagggctttgcgttatgtcctaagatcctcataaccaccctgcaaggggactatcatcattacctctgtattacagatggagaaactgaggcacagagaggtaacgtgacttgtctcaggccataaagctggggaaagtagtggagctggttttgaacctgagctgtgagacctcagagccctaaactctggtgcctgtgtgttcccctttcaacccagactttggaaatcagtagacaccatatgcttcaaaaaacaggggctattaaaatgacatcaggagccagaaagtctcatggctgtgctttctcttgaagtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 443978 - DNA, 787 bp, Homo sapiens
ccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtgccccggggacagggacgggcatgggcattgtgtggaccccgggagctagaagaggcctctcctgctgatctgagtgaagagcgtgggagtttagtccag

SEQ ID NO: 443979 - DNA, 1598 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatgg

SEQ ID NO: 443980 - DNA, 308 bp, Homo sapiens
aacgttggatccgaattcggatccaattcggatccaacgttggatccgaattcggatccaacggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatgg

SEQ ID NO: 443981 - DNA, 2239 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443982 - DNA, 2213 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcaagctggcatgcatgccgctgctgactgtagatggagtcccggaacgagttctttgactctactggagacgggatacttcatgccttcctgctcttttcatgacagtaatattatcacaaaatacggtctttggatagtgtggtgcacctccacccaccagcattcatcgctccggcatttaccagatgacacatgctagtcccgctctctaccactcaccaatgtcatcaccattcctgagcctccgtggagctgaccagagtcccagcaccactcttctgtacatcatgcaggacacatcccggggtaccg

SEQ ID NO: 443983 - DNA, 1770 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaaaaaaaaaaaaaaaaaaaaaaacactttgttggcgccgcgccttgggcccttggaagaagagctttctttaaacacattcgggttgggcgcgcgcggggcgcccaggtagggtataagtgggacactgtgtggcctatatacgcgtgtgttcccatatgggaaaaattccg

SEQ ID NO: 443984 - DNA, 2219 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatgtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443985 - DNA, 1268 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcgatcgcccgaatcctgagatcacccagc

SEQ ID NO: 443986 - DNA, 2186 bp, Homo sapiens
tgccaggctggtaccggtccggagtcgtatggatgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443987 - DNA, 1078 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagccgcggtggatcctcaagagtcaggcaga

SEQ ID NO: 443988 - DNA, 2661 bp, Homo sapiens
gtggatgcttcagctgggctggtcagttcccctctcttacccacggatcccatctcaggaaaacagcagccagccatggcctgggctgggcagcgctaggcataggggctgctaccaggctcttctggccatgggtgccccatgcaggtttggccacggctgcctgggccttagctgaggcctgaggaaagatgtcagccttgggcagactctgtcctgggtctgcaagggttgggaaagctgctgggctgggtaaggggcagtgcgcggacagtgaggggactcggcctggggagctggtctggaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttacggtgacaaaagatatttaagttttgtcttttttttttttgcttattattcttattattagctcttattttattggatgtttattgacccctttacctgaggggcgccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtatctgatgagtctccttcctccctgcgacactgtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443989 - DNA, 1029 bp, Homo sapiens
  misc_feature (1005)..(1005): n is a, c, g, or t
  misc_feature (1007)..(1007): n is a, c, g, or t
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagccaatgagnanggtgggaatcctctgagattac

SEQ ID NO: 443990 - DNA, 1077 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagccttgtcaagcattgcctgtgattgcccagcccagattcatctgtgccttggacatgtgatggcaacccatcaccatccgg

SEQ ID NO: 443991 - DNA, 2163 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443992 - DNA, 1732 bp, Homo sapiens
cgcacttctgcacccaggcgcacttctgcacccaggcgcacttctgcacccaggcgcacttctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443993 - DNA, 1741 bp, Homo sapiens
ccggacacacaccccattggcccgacacagtctggccctcggggtgtcagcaattcgagcgcaaggcactccttaacgtcgatcgtttaaagaagctctccaggccccaccgagaagcggtcggatcgacgacctcagagggaaggaagataatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443994 - DNA, 930 bp, Homo sapiens
agagagagagagagagagagagagagagagagagagagagagagagagagagagagagagagagagagagagctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443995 - DNA, 844 bp, Homo sapiens
tgccaggctggtaccggtccggagtcgtatggatgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggtaatgtagtttcctcttctgtaaggggggatgagagcaggagctgccttgtgggtgtgtgaagatgcctggtatgaggaaggtgctgagcagagcagctgcagttgctctgtcagccaggctgccctccctgcattagccctgtatccaggcttcactgcacatggaagcccagccccaacccgctgccactccaggtcagtggcaggccctgcccgggggactgggaggtggagtctatcaagagagagctgggttgggagatggatgtgctgggggtggccttgaagactttgaagagccagcatattccagtggtctctgaccttgtcccctgtgtgcccctgagcactggtgtgggagataagagagggagagagagaagtggaggaggcggaggaggaagacaggtccagggcaggaacacacacgc

SEQ ID NO: 443996 - DNA, 2234 bp, Homo sapiens
tgccaggctggtaccggtccggagtcgtatggatgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443997 - DNA, 1788 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaaaaaaaaaaaaaaaaaaaaaaaaaaaaaaaaaaaaaaaaaaaaaaaaaaaaaaaaaaaaaaaaaaaaaaaaaaaaaagaagggggggcgcgcgccctacatatatacctcctccccgggggggccccatccgccccccccgcatcttttttgcacaagggggcgcccccaaagaggcgtcttctttacc

SEQ ID NO: 443998 - DNA, 2210 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaataccttttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 443999 - DNA, 1971 bp, Homo sapiens
cgacgtcgcgcgcgcccagaaggccgagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444000 - DNA, 2530 bp, Homo sapiens
gtggatgcttcagctgggctggtcagttcccctctcttacccacggatcccatctcaggaaaacagcagccagccatggcctgggctgggcagcgctaggcataggggctgctaccaggctcttctggccatgggtgccccatgcaggtttggccacggctgcctgggccttagctgaggcctgaggaaagatgtcagccttgggcagactctgtcctgggtctgcaagggttgggaaagctgctgggctgggtaaggggcagtgcgcggacagtgaggggactcggcctggggagctggtctggaccagctgctggtactcccacagactagactcgggaactggggggcctctggcctcttccttgttgccctccaggaggagtgggttaaattctgggtcactaagtatcatctcagaatggcctttaggtcttttgaagattacttaaaaatttgctcagacaaaaagtaagtcatttggaaacaaaggtagttacggtgacaaaagatatttaagttttgtcttttttttttttgcttattattcttattattagctcttattttattggatgtttattgacccctttacctgaggggcgccaactgggtgggcttgggtgggctgaggctgctgccagcgccagggccgtggcccccgcctgctccatggtagccactcagaaggtgctttgtgctcacaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444001 - DNA, 2370 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgagtgggggcctcctctagggtgagtgtccccacagctctgacctggcctggaagccccagcaggccctgagaggccacatgcagtcaccgtccagtatctgatgagtctccttcctccctgcgacactgtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444002 - DNA, 2301 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444003 - DNA, 1942 bp, Homo sapiens
gcagaacaaagaatactccacttttgatagatggggttaccaggattcaggctacatggcctgaggcaaggtcacaacatgagtgacagaatgtgtcctggaagccaggcatcctctggggtgtatttggggcgctcaacaaggcttgatcgagctttgggggtagatctagctattccatggggattcttttcagaattgctgttttcggtaactaattccatgaccaggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444004 - DNA, 2185 bp, Homo sapiens
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaattactcagtctcaagtattttt

SEQ ID NO: 444005 - DNA, 789 bp, Homo sapiens
  misc_feature (748)..(748): n is a, c, g, or t
  misc_feature (757)..(757): n is a, c, g, or t
tgcggcgcgcggctgcgcgggactcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggggcntcatgtctncccgggcggtggctgcgcgggcgacattttcc

SEQ ID NO: 444006 - DNA, 666 bp, Homo sapiens
ccaggctggagtgcagtggcgcgatctcagctcactgcaagctccacctcccgggttcacaccattctcctgcctcagcctcctgagtagctgtgacttcaggcgcccgccaccacgcccggctaatttttttgtatttttagtagagatggggtttcactgtgttagccaggatggtctcgatcgcctgacctcatgatctacctacgtcggcctcccaaagtgctgggattacaggcatgagccaccgtgcccagccctgaggattcctttctagaaatcactccttattacctgaatcagtgtaggtcttcctatgaggattctatccattgagaattccttttcgagaaatcactccgtatcacctccaaatgccttaaggtcttgacttgcctctagcctgatgttcttgaaccaacccttccttgagtggtttatcaagctacccaggctgcaattatagtcttcatggtgtcaaagaactttccccaatccttagctgtctgtatcctctgttccttaaacctttttcttgatgtcctttccaactccaaaatttgcatttttaacagccaactcaatgtcattctttggttccttcgtagcatgccctataccagctcttgcggtcttacttttgacaattacaaggcaaatctgtat

SEQ ID NO: 444007 - DNA, 1921 bp, Homo sapiens
caggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagcctctggcactgaccagctgcctggcctcgggcaagtcacttcacttctctggtcctcagtttcctcatctgtcaaatggggttaataacagaacctacctcgaagagttgtgaggctaaaaagggttcatatgtgtcaagtggttaggacagtgcctggcacatagtaggtgttcaataaatgctagcctttgttactattcttatct

SEQ ID NO: 444008 - DNA, 966 bp, Homo sapiens
agagtccggaggcaggggtggagtgactgaagaccattaagtgtctttcatagaaagaatggcagaggagaccccagttccttcctgagtcccctctccttgggaaaaagtgttcctactctctgggtgagcgtctggtccgaatcgttggcttggagatgattttacggtctctttctggagaacaaaagtaaaaccttacagtgttccgatgagacacagtaggcagtacttgggagggtcttatagaccccaccctgtggaagtgggtctcaacattacacaaccccctctcgggcccgtggacagttgctgtcttctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaaggcaaaatcccatacacagagtctgtcacagaccggacgggactgaaacatccaacgatttctctttccagagccgatcgaacatcactgttcaaggtccggaactggggaa

SEQ ID NO: 444009 - DNA, 3300 bp, Homo sapiens
  misc_feature (1254)..(1254): n is a, c, g, or t
  misc_feature (1396)..(1396): n is a, c, g, or t
gtctgcctcctgtaggtggagcaggccaggaggaagcagcgagaagaacgcctgcagcagctgcagcacagggtgcagctcaagtatgcagccaagcgcctgaggcaggaagaagaagaaacagagaatctcctccgcctcagcagggagatgctagagacaggcccggaggccgagcggctggagcagctggagtctggggaggaggagctggtcctcgccgaatacgagagtgatgaggagaaaaaggtggcgagcggagtggatgaggatgaggatgacctggaggaagaacacataactaagatttattactgtagtcggacacactcccagctggcccagtttgtgcatgaggtgaagaagagcccctttggcaaggatgttcggctggtctccctcggctcccagcagaacctttgtgtaaatgaagacgtgagaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444010 - DNA, 3308 bp, Homo sapiens
  misc_feature (1187)..(1187): n is a, c, g, or t
  misc_feature (1329)..(1329): n is a, c, g, or t
agaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444011 - DNA, 3228 bp, Homo sapiens
  misc_feature (1107)..(1107): n is a, c, g, or t
  misc_feature (1249)..(1249): n is a, c, g, or t
agagtccggaggcaggggtggagtgactgaagaccattaagtgtctttcatagaaagaatggcagaggagaccccagttccttcctgagtcccctctccttgggaaaaagtgttcctactctctgggtgagcgtctggtccgaatcgttggcttggagatgattttacggtctctttctggagaacaaaagtaaaaccttacagtgttccgatgagacacagtaggcagtacttgggagggtcttatagaccccaccctgtggaagtgggtctcaacattacacaaccccctctcgggcccgtggacagttgctgtcttctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444012 - DNA, 3257 bp, Homo sapiens
  misc_feature (1187)..(1187): n is a, c, g, or t
  misc_feature (1329)..(1329): n is a, c, g, or t
agaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggtgcgggcgtcatgctgagcttgggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444013 - DNA, 3419 bp, Homo sapiens
  misc_feature (1187)..(1187): n is a, c, g, or t
  misc_feature (1329)..(1329): n is a, c, g, or t
agaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagtccataggtgagcctggctgcctccagctgggtggacagatgggggctggagaaggggagaacaggaaagaggggttgcctgccctgtttcctatataagtctgaggaaggcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444014 - DNA, 2575 bp, Homo sapiens
  misc_feature (454)..(454): n is a, c, g, or t
  misc_feature (596)..(596): n is a, c, g, or t
ggctgtactggctggaatttttgggatcacgggcatgcacagcgtggatgtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444015 - DNA, 2469 bp, Homo sapiens
  misc_feature (1187)..(1187): n is a, c, g, or t
  misc_feature (1329)..(1329): n is a, c, g, or t
agaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccgcccagagcccccggccaggcacccccagggaaggctctggtggagaacctgtgcatgaaggccgtcaagccatggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444016 - DNA, 338 bp, Homo sapiens
acagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacaaagcctcctggtctggctccaaagcctggcagggtcttttccccgggggagctgcaggcagggaacagtcctgatgggtcatccccttcactcccagccccagagcccccggccaggcacccccagggaaggctctggtggagaacctgtgcatgaaggccgtcaagcca

SEQ ID NO: 444017 - DNA, 343 bp, Homo sapiens
aaatacagatgctcttcttacttgatgtgcagtgtggagggagagaagatagggaagggttggggggcctgagaaccaccattgtgacctatttccattctcttttttagggaacattaagcaaaatcccaatacacagagtctgtcacagacaggtaagagagttgccctcagagggcccagagctgatctgagccacttccgagcttaaccctgggactgaaacctgaggcttagggtgaagctcccaaggcccttcatgtgtttgttctcagggacggagctgaagaccatcaacgactttctcttccagagccagatcgacaacatcaacctgttcaag

SEQ ID NO: 444018 - DNA, 451 bp, Homo sapiens
cccgccattgctgctgtgcagaaggtcagtcctacctttttctttctgagagcctcccaaccccgagatcacatttctcactgccttctgtctgcccagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggca

SEQ ID NO: 444019 - DNA, 312 bp, Homo sapiens
aggtggcacctaccaccccgtggttcccacccaggggagccaagtcctcttcatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444020 - DNA, 3484 bp, Homo sapiens
  misc_feature (1254)..(1254): n is a, c, g, or t
  misc_feature (1396)..(1396): n is a, c, g, or t
gtctgcctcctgtaggtggagcaggccaggaggaagcagcgagaagaacgcctgcagcagctgcagcacagggtgcagctcaagtatgcagccaagcgcctgaggcaggaagaagaagaaacagagaatctcctccgcctcagcagggagatgctagagacaggcccggaggccgagcggctggagcagctggagtctggggaggaggagctggtcctcgccgaatacgagagtgatgaggagaaaaaggtggcgagcggagtggatgaggatgaggatgacctggaggaagaacacataactaagatttattactgtagtcggacacactcccagctggcccagtttgtgcatgaggtgaagaagagcccctttggcaaggatgttcggctggtctccctcggctcccagcagaacctttgtgtaaatgaagacgtgagaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacaacgaatctcgacaagttgtgcttaaaagaccacatatggtatgattctatttaaatgaaatgtccagaataagcaattccatagagacagaaagtagacgagtagttgtcgggggctggtaggaggggataatagggagtgatagctagggatatggggttccttaacgggagggagcttaaaaacgttctgcaattagtgatgattgctgcacaacttgtcgagattcg

SEQ ID NO: 444021 - DNA, 3197 bp, Homo sapiens
  misc_feature (1187)..(1187): n is a, c, g, or t
  misc_feature (1329)..(1329): n is a, c, g, or t
agaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtctgcagagctgcaggagaagatggcctacttggatcaaaccctcgcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444022 - DNA, 3190 bp, Homo sapiens
  misc_feature (1069)..(1069): n is a, c, g, or t
  misc_feature (1211)..(1211): n is a, c, g, or t
agagtccggaggcaggggtggagtgactgaagaccattaagtgtctttcatagaaagaatggcagaggagaccccagttccttcctgagtcccctctccttgggaaaaagtgttcctactctctgggtgagcgtctggtccgaatcgttggcttggagatgattttacggtctctttctggagaacaaaagtaaaaccttacagtgttccgatgagacacagtaggcagtacttgggagggtcttatagaccccaccctgtggaagtgggtctcaacattacacaaccccctctcgggcccgtggacagttgctgtcttctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaataaccctcccacctgcaacagctgcccctgctgactgcgcctgtcttctccctctgaccccagagaaaggggccgtggtcagctgggatcttctgccaccatcagggacaaaccgggggcaggaggaaagtcactgatgcccagctgtttgcatcctgcacagctacaggtccttaattaaaagtgtactgttggttaaaaatgaaat

SEQ ID NO: 444023 - DNA, 3170 bp, Homo sapiens
  misc_feature (1254)..(1254): n is a, c, g, or t
  misc_feature (1396)..(1396): n is a, c, g, or t
gtctgcctcctgtaggtggagcaggccaggaggaagcagcgagaagaacgcctgcagcagctgcagcacagggtgcagctcaagtatgcagccaagcgcctgaggcaggaagaagaagaaacagagaatctcctccgcctcagcagggagatgctagagacaggcccggaggccgagcggctggagcagctggagtctggggaggaggagctggtcctcgccgaatacgagagtgatgaggagaaaaaggtggcgagcggagtggatgaggatgaggatgacctggaggaagaacacataactaagatttattactgtagtcggacacactcccagctggcccagtttgtgcatgaggtgaagaagagcccctttggcaaggatgttcggctggtctccctcggctcccagcagaacctttgtgtaaatgaagacgtgagaagcctaggttctgtgcagcttatcaacgaccgctgcgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacatggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggcttcactgaacggtacggagcagtgttctcatcccgggagcagcccaaactggctgggtttcagcaattcctgcagagcctgcagcccaggacgactgaagcncttgcagcccctgcagacgagagtcaggccagcgtcccgcaaccagcttccccactgatgcacatcgaaggcttcctggcagctctcactacggccaaccaggacggcagggtcatcctgagccgccaaggcagcctcagtnagagcaccctgaagtttttgctcctgaatccagctgtgcactttgcccaagtggtgaaggaatgccgggcagtggtcattgcgggggggaccatgcagccggtgtctgacttccggcagcagctgctggcctgtgctggggtggaagctgagcgcgtggtggagttttcctgtggtcacgtgatccctccagacaacatctgccccttgtcatctgcagcgggatctccaaccagccgctggaattcacgttccagaaaagagacctgcctcagatgatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcgtattccaggtgcatccaggcctgtggccaggagagaggccaggtgacagaggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaagccagcagggccatcaggcaccagaaggattttgccagcatagtgctcctggaccagcgatacgcccggccccctgtcctggccaagctgccggcctggatccgagcccgcgtggaggtcaaagctacctttggccccgccattgctgctgtgcagaagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccaggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtggcatccactgtggcatctccgtcctgcccaccttaagaggcgagatggagcaggcccatctgcctctgccctttctagccaaggttatagctgccctggactgctcactctctggtctcaatttaaaatgatcccatggccacagggctcctgcccaggggcttgtcaccttcccctcctccttcctgagtcactccttcagtagaaggccctgctctctatcctgccccacagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtgtctgtcactgaaacctattttgtgggagactattcctctcatctgccactcatgacctgctaaacgacggccctcctccctctcactaccccgacagaccgattactatg

SEQ ID NO: 444024 - DNA, 212 bp, Homo sapiens
ggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaaggtgagtggcctgtcggcagccttgccacttgtgaggacagtgccactgagtcctcctgggagctcttgtg

SEQ ID NO: 444025 - DNA, 2074 bp, Homo sapiens
atacaggtctgtgaagcaggcaggttgctcagctgcccccggagcggttcctccacctgaggcagactccacgtcggctggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtatacc

SEQ ID NO: 444026 - DNA, 2601 bp, Homo sapiens
  misc_feature (1315)..(1315): n is a, c, g, or t
ggctttttgaaaaattatctagaggtactctttgcaagtgtgagtttacactggtctttatgaaacagagctaaagcaaaacagatataaacagcttctttttttttaattttttttggggacggagtctcgccctgtcaccaggttggagtgcagtggcacgatctcagctcactgcaacctctgcctcccgggctcaagtgattcttctgcctcctgagtagctgggactacaggcgtgtgccaccacgcccagctaatttttgtatttttagtagacacagggtttcaccatgttggccaggagggtatctcgatatcttgacctcgtgatctgcctgcttcagccttccaaagtgctgggattacaggcatgagcctaaacagcttcttgagggacagtcaaatcagtaccacagattctactttttctgttaacatagtgagtttctaaagttgatttctaatagcagtgtgcctagagtactttgaaatttgtctattacttttaccagatagctaacatggtatcatatatacagtgggggctactatttgatgtttgcagatattgtgaaaaaatactgtacaaagcagtggttcttaagcctcaatgcactcagaattacttaatgaggagggagctttttaaaaatacagagccctgagcttcattttagaccagttaaaaccgccaggcaattgtaatgtggtcaggtttgagaagcactaataatataaaatatctttttgcactgctgatgtttttctactgtattcatcttagctctttgtgatgctttaattatttcatttatggtgatttacttttccagtgtgtctaaagtgagcacaacttggaagaagatcctagaagatgataagggggcattccagttgtacagtaaagcaatacaaagagttaccgtaagtgtttgcagatgatgtttttagttaaaaatgcactgttagtgctcttctagaaatagaaaagaaaagaggtaatctggaaacccttctttacagtcataaagtatttcagccttatactggaacttagaaaccacattcaaaaataaagaaatctcaactcaacatttatttcttggattcttcctagaaatagaatgtctaaagtaacaaagggaaaattactcatttctcagatagagtcgaccatttagtcaatcttagttgccagttgtgtgtatgtgtattttataacatctggaaaatttggaaaagctgttttactttttaggtattaagtaccatatagactgcatctaaagtgatttcccatagtatttggttnacagtttctgtctataagttaggcttgatatgtgtgagtatttaggttttgctttgtttaagtacgtgcaggtaaattgcatgtagggataagtctcttacctaatcttgtttgtcatttcttatatgtacaaacataaaaatgtctcattgaggatacaggaaataatttctaaattctattaaaacttttttttaaattaggaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtatacc

SEQ ID NO: 444027 - DNA, 2015 bp, Homo sapiens
atacaggtctgtgaagcaggcaggttgctcagctgcccccggagcggttcctccacctgaggcagactccacgtcggctggcatgagccggcgcccctgcagctgcgccctacggccaccccgctggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtatacc

SEQ ID NO: 444028 - DNA, 2206 bp, Homo sapiens
ttaggagggagagcagagcgcgcgcgtaaatcctagagaggcgggctaagctggactggggggagggtccgtcttccggaaagtctggattcccggacgagccgagttgctgctcaccgaactcccgttcgagagatgatcgaagaaagtcggctaccatttgtacccatcaaagatctccagatggaagccagcgctgaatttgggctgagattaggacttgcaggaggccggtccagaagacggcggaaggaatcttggcgggcgcacgcatgcgtgatagaccctccacacgtgtggccgggccgcggcctccccgtgctcggaggtcccgcccccggccgtagcatctttccggacgtggggagccggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttgaaactgaaagcaagcgcttgcataacaaggagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtatacc

SEQ ID NO: 444029 - DNA, 403 bp, Homo sapiens
ttttgggagcaggactactgtctcctacacctggccctttaaggaaaggaacaaaaacccaggggagcgtagctgcacactcagtaaacttaacgttcctataaaccagtagcgtctgaagtgtggttgaaaatacaaataaacgcgcttgcaaggaagaagtgcctcggtcctaccctcggccccgccggaaggccctgggagatgcagccgcaggtctcctgctacagccgctggggaaggccgcacagcctcctcgcccaccccggaggaaaaaatcgcgggggactccagtgcgcaggcgccgacccgccaactccgcagccacagcccgccaaggcgcctgcgcagaggcgtgggtcaaggggagggtcgagttaggagggagagcagagcgcgcgcg

SEQ ID NO: 444030 - DNA, 2260 bp, Homo sapiens
ttaggagggagagcagagcgcgcgcgtaaatcctagagaggcgggctaagctggactggggggagggtccgtcttccggaaagtctggattcccggacgagccgagttgctgctcaccgaactcccgttcgagagatgatcgaagaaagtcggctaccatttgtacccatcaaagatctccagatggaagccagcgctgaatttgggctgagattaggacttgcaggaggccggtccagaagacggcggaaggaatcttggcgggcgcacgcatgcgtgatagaccctccacacgtgtggccgggccgcggcctccccgtgctcggaggtcccgcccccggccgtagcatctttccggacgtggggagccggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtatacc

SEQ ID NO: 444031 - DNA, 320 bp, Homo sapiens
gcggccgcctactactactactactgctcgaattcaagcttctagtacggggacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444032 - DNA, 1074 bp, Homo sapiens
tgactcatttctggctgcaacataaagagtagttggaagtaaggttggaaagatttaggaggatgtccctggttgaaaagttggagtcatagaatcacagaatgtttgagcctgaaggaactgaggaaagtctgtttctcaaatttacagagttggagcacttacccagagaagttaaatgccttttgcaatgttgtatagctaggtagtggcaggtcttctaactcttgcttgagttcagcctagacagcactatctaagatagctcacataaggttattctggcattggctgacggaatggatttggatgcaggcagatcagagattggtttggagagtgatagaatattccagctcgtaaatagtaagtgcttaaaatagagtgatggcactgtgaataaaaaccaggagacatatttggggcatgttgcagaggtaaaactatgggacaaggagttgtctaagatgttatttccactgtaagaaactggcatcctgagacatagggaggttatgaggactacttccaacagatacgagggaacactcagcacttctgagttggttgtaccctgccaagataaaatggcttctttgaaacagtaatgaaactgtttcttacattcctgtggacttgactttttccccagtatagtatttttatttatttatttatttatttatttatttattaccaatacaatacttttaaatttaacaattttagccatctcggtatggattaaaacatctagatgatgtaactcttatgttttgctaggattgctactgtgcttttggcagccactttacaatctggtgcttgacatattgaacaatttcccctaaaggttagtctgagagagtttaggatttggaaatgaaaaagatctttgttaggaaaacgtgatgagacaacatagtgtcaactttaagaaaaaaaaaaaaacaaccatagtcataactaccatttactgagtgcatccttgtgctcagttgcattaggcacttttctcactgaattctcatgataatctccactttataaatgaggaaactaagtttagaggga

SEQ ID NO: 444033 - DNA, 322 bp, Homo sapiens
tatctttttttccgataatttttccgcattttggccaatttcgcgagattgttgggggttggtaaattataaatattaagtttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtctaatgggttcactaagagtcggcaagggctttccaacacgagaacggtgctt

SEQ ID NO: 444034 - DNA, 1727 bp, Homo sapiens
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444035 - DNA, 816 bp, Homo sapiens
cagaaggagagggcggggggaacgtgagaggctatattttcagcagagctgagtaaacttcattgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggttgtagttcaggaggtcccaaacggggacgacctcatttaacccgccgggggggaaaaaccgctggagcgggggcaccccactagggggagtaggtaaaagacatctccacgag

SEQ ID NO: 444036 - DNA, 615 bp, Homo sapiens
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaaggtaagtttattttgcctttcatttttgatatacccagaatttagtatcaagagagttgagtgtaaaattctgttcttcta

SEQ ID NO: 444037 - DNA, 4025 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagccagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444038 - DNA, 4680 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444039 - DNA, 4794 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaacaaccaagtttttcatgcgggccaaattgagctcatttgcccatccccctttaggggggggttaccaatccga

SEQ ID NO: 444040 - DNA, 4755 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaaaaaagggcgcgccgcctaaagataccc

SEQ ID NO: 444041 - DNA, 5002 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaagaaaaaaaaaaaaaaaaaaaaaaatttggggggggtaggcccctggaaaaaagcttctgaacccattacgttgtggggcgcgcgggccccaagcaggttaaggtgaaaagtgtggccataaagggttgccagaggaaaaatccggacaaggaacgctaaggtggtgtgatttctccaccattaaaaaaaggcccgggggggaacacgcaggtttcgtcaacaaacccaacagggagtcagaggccaaccgggtccacaacgaggatccagcgcaccgcattaaa

SEQ ID NO: 444042 - DNA, 4570 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgatgagccgtggacctcagagcagcgagac

SEQ ID NO: 444043 - DNA, 5545 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccattctttttgaaaagttgtatatttcccttttcactctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444044 - DNA, 2025 bp, Homo sapiens
tctagctccaccatctctgcaacttgccaagatgcggcaagactatctgcaacaaagtaaaatatacaggttttttattccaccagtgcctcagataggaaaaagatatgattacggtttaaatccatacatagcagctctactactccccttttcatttatagtgttacataagcctaaataatcactgtagctggtggcatcatgtttgttacctactaagtaggtcaaagtgattgccagacatacacatgaaggccttgaattagaaagcaaaggaactgatgatgaccaatgtttaacaaaattcagactgactttgtgcctgatccttcaaaggctagaggtgatatttttggtacctgaaacgtaatttccctgataagtactctttgcccaattattgcttatcagctgagatattaatgtctgaattattcagctcatatatcttcaagcactcaactagttcatactttgaaatcaattctaatagacaattctcataacacctttatagtcttcccatttaaaaggtaaatgttgttagggctggaggggtaagatgcacccttggtatattgtctgatctcagcagaatcaactacttggtagtgtagtccagagaaaatgggtcaaatctattaattattttaggattttgaaattcataattgagactcgtgacttaatagtgaactgctcatggtactttacccagtcttcaagttgtatgccttttgtaggtaggcatttagatgggatgcttttgaaagcataattaagaaactttacttgaattttgtttataatgggctaatgttattttcttatagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444045 - DNA, 4566 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagttattaatgctccttgaagcttgctgatctgatttgttagctttctgtggattctccaggatcttctgcacccaaatccatgcccactctgaatgatgttattttctgcccagcgtccataaattagactgagaccctctagatccagactcaaccgta

SEQ ID NO: 444046 - DNA, 4680 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagaatggtgtagatggggaatagtggcaagtatttaggtcatggaggggcagagatctcattaatggcttggtgccatccttgcagtgagtgaagttcttaattactttctgtgagagatgggtgaaaaaacaatattcagttctatttaattaaaatttagttcttcatttacactagccacatctcaagtgctcataaccacacacagtacctacatcattggacagcaccactctaaacaatgaaaaaattaagaaaaaagggagttttttg

SEQ ID NO: 444047 - DNA, 5744 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccattctttttgaaaagttgtatatttcccttttcactctcatttcactcttcagtgttcctgttatttatgaacggcatcaggtaatttcctaactaactgctgacttcagaatagagcactcactctattacatgggatttacggatgtattagtgcccattttcaatgtcttacaaaaatgagaagtgtgatggtttcttaagcctttagcttgacacatagtagtggttaataagattctttagcaacggtaataattcctttatacctctctttcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444048 - DNA, 2852 bp, Homo sapiens
tctagctccaccatctctgcaacttgccaagatgcggcaagactatctgcaacaaagtaaaatatacaggttttttattccaccagtgcctcagataggaaaaagatatgattacggtttaaatccatacatagcagctctactactccccttttcatttatagtgttacataagcctaaataatcactgtagctggtggcatcatgtttgttacctactaagtaggtcaaagtgattgccagacatacacatgaaggccttgaattagaaagcaaaggaactgatgatgaccaatgtttaacaaaattcagactgactttgtgcctgatccttcaaaggctagaggtgatatttttggtacctgaaacgtaatttccctgataagtactctttgcccaattattgcttatcagctgagatattaatgtctgaattattcagctcatatatcttcaagcactcaactagttcatactttgaaatcaattctaatagacaattctcataacacctttatagtcttcccatttaaaaggtaaatgttgttagggctggaggggtaagatgcacccttggtatattgtctgatctcagcagaatcaactacttggtagtgtagtccagagaaaatgggtcaaatctattaattattttaggattttgaaattcataattgagactcgtgacttaatagtgaactgctcatggtactttacccagtcttcaagttgtatgccttttgtaggtaggcatttagatgggatgcttttgaaagcataattaagaaactttacttgaattttgtttataatgggctaatgttattttcttatagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccattctttttgaaaagttgtatatttcccttttcactctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444049 - DNA, 4800 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagccctgtgccccgtggtgttattggccccggtgttaaatggattgccaaatttttctgaaaatctgcaaaatgttgtttgtgttttgaaaacgaaaaactcatcccggttaaaggcaggaattgaccaaagcctttggctttttccgtgggatagtgtcccataggggtggtacttcggtggcacctttaaccgtggtcgattattttaatgtgcgcccaaattattaagcgtaaacattattactgattctactactcttcgtatctcgcgtggtctccaccaaaagcgcttttaagacctttttaccttttccacgccacccccccacaaggtgtgctggaataatctccagagagcggtcaaggccaatgggggtttaatcatcctgtttgttgtacgttccccaaagagcgcacatttaaggcttaaagaaaccgacaggacacattatttttccttaagggaggcccatctaacccattttctggtgtcttccccacacctattggaaaattgggcccaccacacctattttagaacatctccccaaagctttgcaatattgtccctatttgggccacccaaggaactgggacactgggtaaggtttaaacaattttcgtggcgcccaccaaagaaaattccctaatgggggacccttggggaaattcctagaaatgggctctccca

SEQ ID NO: 444050 - DNA, 6108 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccaaatcattccattctttttgaaaagttgtatatttcccttttcactctcatttcactcttcagtgttcctgttatttatgaacggcatcaggtaatttcctaactaactgctgacttcagaatagagcactcactctattacatgggatttacggatgtattagtgcccattttcaatgtcttacaaaaatgagaagtgtgatggtttcttaagcctttagcttgacacatagtagtggttaataagattctttagcaacggtaataattcctttatacctctctttcaggcacagatagatcattatctaggacttgcaaataagaatgttaaagatgctatggctaagtaagtatttaaaatctgcagtgtttttactaggataaggtgtgctggattgtgagaacagtattttcatattgcaggcataatgagtaacaaatctctatcagaccttaagtgtgacttcagagttgccaaaagattgtttttctaacatttggaccattcgtttctgggtttattatgtgtttaaggctttgtttaaatctaattcatgaggccaaggtggcaaaattatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444051 - DNA, 4661 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444052 - DNA, 4834 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaggggggggttaaatatcccgagggccaacttagcgtaccgtttttgtcaagggcccaaggggcggttataaaggcggcggttaccgttctggaagccgggactggagaccccctgggtcatggcaccccattgctgaataaggtagtccaatggaattgataca

SEQ ID NO: 444053 - DNA, 629 bp, Homo sapiens
atggctgactctagaggatcacggtttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444054 - DNA, 4241 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttattttgaactgcacgatacaaggaactcaggcgcctcttcttagttcgatgatttacgttgattctctgaagtttgcagtgttgactgtgggtatttagctatgtcggtgcctctgtttcatggtctgacacttactgatgtcggctctcatttcactcttcagtgttcctgtgtttacacaaatgctggatgatagtctttctaggatgtttcataagcactcctttattgggcccaaagtttagactaagtgctttacaaaggttctttaaacaaaaacaaaaacagaaacatttattggctgggcacagtggctcatgcctgttatcccagcacagaaccaccaacaagatcagatcctctag

SEQ ID NO: 444055 - DNA, 3767 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaatccaagctaaaatcgctggattgaaggcaagctgaatgtaacaccccaccctatgcttaat

SEQ ID NO: 444056 - DNA, 4702 bp, Homo sapiens
  misc_feature (4426)..(4426): n is a, c, g, or t
  misc_feature (4558)..(4558): n is a, c, g, or t
  misc_feature (4610)..(4610): n is a, c, g, or t
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttgggtaagtctacaaagccattgggatgaaaaattgctggaaagattgtgtgccaggagcttagacattttagtggagaatattctcattgtatgaaaagtaggggatgaaaatgtgggccgggcgcggtagctcatgcctgtaatcccagcactttgggaggccaaggtgggcggatcacctggggccaggagttcgagaccagcctggctaacatggtgaaaccccatttctactaaaaatagaaaaaattagctgggcgtggtggcgcacgcctgtaaatcccagctactccggaggctgaggcaggagaatcacttgagcccaagaggcagaggttgcagtgagcggagatcgtgccattgcactccaggttgggcaacaagagtgaaactccatctcaaaataagtttgaggttgtattctctttaaataagttggtgatactgcttcccggtttattgaaatgctaccttagttgctgaagacagctcctactaacaaacagtgataaaccagataaagggtggctttatatgatggtgcagtcataaatctaaccagggatacctttattttatgaaatctcactgtgatatgatttgaagctagaaatggttcctagctctaataactgcagcctcacacagttcattcattcctctggagtggctcctcaacagcagatgcatccagagatccttatgtttttattcattcattaggaacactgcttggttatcttgagttgccagtttaatagttttttgagtgtttattcctcccagagtgctgggattacaggtgtgagccaccgtgcccagcctacnattatgactatttccatttgaaaccatcttcctcagaaattgaaattttagagccgctcttgctagcatgtgaaccttttccttgcttattgccttttggcgggggcagtgaaggaggagcctggcctttcnaaatgtgatcaaaaaaataaccgaactccagggctcattagtccttttatanacgccggtgtgaaatgatgggtatccgtgtgcctgtccatttcctggtgttgacttggcgaataaaaataagacattcctgctattcctctg

SEQ ID NO: 444057 - DNA, 3729 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaagggcag

SEQ ID NO: 444058 - DNA, 1107 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttaacctcctgaactggacagactttgccacagactgaattgctcttgtgtgacacactgatgcttgaactcacgttgtccagtgttatgattgcaatctggacctttataatttccatgggcctttgatggaaaccctcaactttggcatcaaatggggccctgatagctgtcgctcatcatgctaaaggcacccttccctggcctctctgcaaccgtaaatgtgtatctaagggctggttcttaagccctttaatcctcacgttggctctcaacttgaacggcttctgggacctagtcatcctgcctaatcgtctattcgctcatttctctaatattacatgcgtttcgggtgctcaaccttgctgggccttcccaatct

SEQ ID NO: 444059 - DNA, 438 bp, Homo sapiens
agactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaagggtatatctgctttttaatttcttattcagtttttatatgtgaccactaatatatttctatgaataagctttggaatttagatattttggattgaaagtgaaacctctgaagagttgaagtctaaaggattaaaacggctatctcacgtgtttttacatttggttgtataccagaaaatgtcatgctgttctgtttcactggcattcggtttagtcttttcagtcctgccgtttaggttctgttctctaatcttgcacattgtaaacaatatagatctaa

SEQ ID NO: 444060 - DNA, 1784 bp, Homo sapiens
agcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444061 - DNA, 4718 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444062 - DNA, 2261 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444063 - DNA, 2462 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttgttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444064 - DNA, 4891 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaaaaaaaaaaaggggggggttaaatatcccgagggccaacttagcgtaccgtttttgtcaagggcccaaggggcggttataaaggcggcggttaccgttctggaagccgggactggagaccccctgggtcatggcaccccattgctgaataaggtagtccaatggaattgataca

SEQ ID NO: 444065 - DNA, 4668 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagccctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444066 - DNA, 4648 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444067 - DNA, 2176 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444068 - DNA, 4733 bp, Homo sapiens
  misc_feature (4307)..(4307): n is a, c, g, or t
  misc_feature (4310)..(4310): n is a, c, g, or t
  misc_feature (4322)..(4322): n is a, c, g, or t
  misc_feature (4333)..(4333): n is a, c, g, or t
  misc_feature (4340)..(4340): n is a, c, g, or t
  misc_feature (4346)..(4346): n is a, c, g, or t
  misc_feature (4357)..(4357): n is a, c, g, or t
  misc_feature (4362)..(4362): n is a, c, g, or t
  misc_feature (4393)..(4393): n is a, c, g, or t
  misc_feature (4401)..(4401): n is a, c, g, or t
  misc_feature (4403)..(4404): n is a, c, g, or t
  misc_feature (4407)..(4408): n is a, c, g, or t
  misc_feature (4419)..(4419): n is a, c, g, or t
  misc_feature (4431)..(4433): n is a, c, g, or t
  misc_feature (4453)..(4453): n is a, c, g, or t
  misc_feature (4459)..(4459): n is a, c, g, or t
  misc_feature (4470)..(4470): n is a, c, g, or t
  misc_feature (4475)..(4475): n is a, c, g, or t
  misc_feature (4486)..(4486): n is a, c, g, or t
  misc_feature (4492)..(4492): n is a, c, g, or t
  misc_feature (4495)..(4495): n is a, c, g, or t
  misc_feature (4498)..(4499): n is a, c, g, or t
  misc_feature (4503)..(4503): n is a, c, g, or t
  misc_feature (4521)..(4521): n is a, c, g, or t
  misc_feature (4531)..(4531): n is a, c, g, or t
  misc_feature (4535)..(4535): n is a, c, g, or t
  misc_feature (4548)..(4548): n is a, c, g, or t
  misc_feature (4555)..(4555): n is a, c, g, or t
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtaaaanaanaaaaaagaaaantgaaccacaanacctagncccccnccccccacccnccccncagcccccaacaacccaaacccacccaccgncaacaccncnncanncccaaagcacnaaagccagaagnnnaaacacccccaggagcaccnccatcngtttacaacangaaancccacacacanagaacnccnacnncacnaattgcatggcacagacngggggtaggngatngcgtgagcggggnggagggncaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444069 - DNA, 4601 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444070 - DNA, 5082 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaagtaagtatttaaaatctgcagtgtttttactaggataaggtgtgctggattgtgagaacagtattttcatattgcaggcataatgagtaacaaatctctatcagaccttaagtgtgacttcagagttgccaaaagattgtttttctaacatttggaccattcgtttctgggtttattatgtgtttaaggctttgtttaaatctaattcatgaggccaaggtggcaaaattatagcttagaattaggcagctttaaggatttcatttattgtattagctgaataacatacaagtagttcttggaagatggtattttaagcagcagcaaacaaaactgatatttacattgactttttcattttcagaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444071 - DNA, 4437 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattaatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444072 - DNA, 4690 bp, Homo sapiens
  misc_feature (4022)..(4022): n is a, c, g, or t
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaganatgattacggtttaaatccaagcaaaaatccctggattgaagcgcaaagctgaatgaaaacgcccaaaataattagtaggagttcatcttttaaaggggatattcatttgattatacgggggagggtcaggaaagaaacgaaccttgacgtagcagtgcagtatcacagatcgtagtagatcttataatagccatgcaatgtagtgaggaaaaattagctgtacttgatgacatgtgttcatcatctaaagtattgtaagctgctatgtatggatttaagcgtaatcatatctaatcctaatctgaggcactggtggataaaaactgtatatatacatagagagataggcatagccgacatggcaagatgacgagagtgggagcacaagaagaaaaaaaagcccaaaaggagaaagagaagagcaagaaaagaagaaatagaaagagacagagagcaaaacacaaacagaaaacaaagagaaaaagagtacgcaacgcaggaagaaaaacaggaaaagagaaatagcaagaaacaactggagaaacgagaatatcacacacaaaagaaacacaaaagataacgttgcaagaaaacagaatagaacaacaatacaacaaataaaagaaaagaacaccgcaaagaaaagagggcacaacaaccgacagaa

SEQ ID NO: 444073 - DNA, 3766 bp, Homo sapiens
  misc_feature (3709)..(3709): n is a, c, g, or t
  misc_feature (3731)..(3731): n is a, c, g, or t
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatncaacaaaaatcctggaatgaanccaaagcttaatgacgcctttagtaggagtctttt

SEQ ID NO: 444074 - DNA, 3820 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgtgtttacacaaatgctggatgatagtctttctaggatgtttcataagcactcctttattgggcccaaagtttagactaagtgctttacaaaggttctttaaacaaaaacaaaaacagaaacatttattggctgggcacagtggctcatgcctgttatcccagcacagaaccaccaacaagatcagatcctctag

SEQ ID NO: 444075 - DNA, 2303 bp, Homo sapiens
ataggctaggtcgggactggggtgtgaatcggccgaaggacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcattaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 444076 - DNA, 1146 bp, Homo sapiens
tcgacccacgcgtcggagcgaagcgcacgctgaggaggatcggctgggggttgggggagtcagcatgattatattttaatgtagaaaatgtgacatctggatataaaatgaaaataaatgttaaattaaatggaaaaaaaaaaaaaaaaaaaaaaaaaaaaaaaaaaaaaaaaaagaaaaaaaaaaaaaaaaaaaatataaaaaaaaaaaaaaaaaaaaaaaagggggggggcggagcgtacagataatagataatagaagaggagaggacgaggtgtagacgcacaacgagtctgaattgtgtggagataaataagtgggcacctaggagagatgatgcgatatataggagatagagaggagggaaatgctacgtgagtattaaacaaactcgagggcaaggaagaggagatagtacatcagttgatcagggaaaaaatatatatatggagggaggaaaaacggatagaataaagataaggggtggtgtaaagtactaagagtatgacaaagtataataaaacagaaaagtagagaaaagcacacagaagaaagagagaaagcaaagcccgacagacgcagcaaaacagagaacaaaaacaaaaaaaaaaaaagaaggaaagagcacagagaggagagaacagacgggagcagaagaaaaagaacacaaaagaacgaaagaacggcgagtagagaggaagagacgaaaaaagaggagaaaagggggcaggggcggaagaagcgaacggaaagggaaagaagagaccgacgcgagacggcgagcgaaagcccgaaagacgacagaagggacaggaacgagaaacaaaacagaggcgaaagaaggggaggcggcggagggcgaggagcggccggaggagaagagggaggagacgccgaggcgagaggaaggagaaggagggagggacaggaggagggagggagaggcgggggcagaggagcagagcggacggcggggaaagaggaaaaagggaaaagagacaacggagaagccgaacaaaggacagacaaagagaagcaggagcaagaaaagagaaacagagaaagaaagaagagcagaagagagccaggacgaaccaggaaaggaccaaaagaagaaaggaggacaagagcgaaagcgaacaaaaa

SEQ ID NO: 444077 - DNA, 379 bp, Homo sapiens
tgcaacgttttaaactgctaacagaccttaaaatatccccctacctgggtcctcagagcaccctcagcgaattttaccctcgagactctgcaaagcattagctgctgcttctgcattgctccgcgctcttgtgaaatactggttctgttttctttattccttttgcactctcggttcccacctttgtgttggagtttaccatgttaccttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatgga
